United States Patent 12,576,115 (BACTERIAL COMPOSITIONS FOR TREATING AND PREVENTING HALITOSIS) - sequence listing, part 20

SEQ ID NO: 30 - DNA, 3359804 bp, unidentified (residues 1-1,679,902 of 3,359,804)
  source 1..3359804: mol_type = genomic DNA; note = Weizmannia coagulans
aagcaaaccgcagattacgatctgcggttttttcatgcactttataaatccggtagttggtcttcctttaaatggaacgctcacatcaaatgaagtagctgttcttttaaatggctgcagttatgatatccggaaaaacagatcggcttcagtttcatgtacgtcatcaaacattccggtttcctcctttagtgtccaaatagatcatattttctaacaaggtgaactgaaccaagccggctgggttatttgtttttcgcctttttaattttatgatcaatgacggaaattccggtaaactctatcaataaaataagaggaatgacaagactgtttacggttttaaaatataatactactataagaaacaggaataaaatggcagcactaaaaatatatctcaatttcaggaagcgaacgatctgtttattgggtatgttattcatatgatgggattcttttataaaaaaggaatcgattttagacagtttcttcgttttcataagaacgagataccggtaaagcaaaaaaagtataagaatgatcatagcaaaacctaacacagtatttatcactgtatcaaacatttcggagcccccatttccgcatcctttacagtctcaacataacatattgcttcaaaaatgactatccataattgaccgttgattcacgctgaaaaagtaaacggacaatgtaaaagaaggaaatccgcagttcttgtgctacaataaatgacgataagaaaatagagaattgtgccaaccgattgataaatggatttcagctgccggggcgaaaagaaatgataaagggctggcaaaggaggaaacaagagaggaggttaataaatggattttattcccattcaagttaggcagcatctccagtatattctcccgttccgcagggattcttttatcgtaagcttcggaacggatgcaaatttcaatgcaagagagtaccttgaatggcttgaaatgcagcaagtacgatttccggaaggttttatgcttgcgattgaaaatggagttccaattggacagcttgaggtgacacgtaaagattttgtaggcaaatcgattggctatgtcaacttgtactatcttattccggaaaaacgcggcttgggtcttggtgctgagctgcatgcgtatgcgatgagcgttttcaaaaaacatcaattggaggaataccatctcagagtatccccgacaaacaagcaggccatttcgttctatgagaaaatggggatgaaatggctaaagcctgaaatggacgggaaagtgttccggatggcagggaaggtttagaacctttaacgataaataaaaagcggatagaagaggagcaaatgcatatccgtattttacatgagtctgatgctgacgcgtaccggaaactttgatgcgtgcactgcaatcaaccccggaggcatttgtcctatcataaagagagaagtcaaattcacaaccgaaactgttaaaaaaccactggcttcgactgaggaggaggcaacttaaaatgagaaatcatccatacgaagaatatgaaaatactgatttatggaataccatttggatggcgattgacgatcttgccaaaaaccaagaccttaaagaaaggacgccccgggcatatatcgttggttatttatgtgaaaagatattgaaagacggcacactgtgaaatatggatgatcatccgtaatccattaactcatttccactcctcctatatattttcctattgttaagggaactatcttcatcttcctttgaggggagtacagtacagcattcttttcgaccaaacttacttcaaatccgcctttttacgggacttttgtagaaagggggtggggggcactttaaaaaacgaataagcatagcgaaagaaaccaaaggcctggaacaaatcaatttaactgttatccggaaatacaatcgcaaagaagcgccagaagcgcgggcgcatttttgaaaatattcatttagcataggggggactgcattgaaaaacaacagagcgccaattgtaatcataagtttaattgcagtcgtgcttttgttcctggtagcggcatacatcctaggatttggctatcatattctatccgtattttttgtgtttttagccctatttgttctctgtattcctgtgtatgtgattgccagattcctatccagctttaaaaagggaacacaagtagccccatccatcaaagtcaaaacaatggatacggtgaatgcagccgtgcttatttgcctgttgatcgtggggtgttatctgaacgcttatggtgcaagggcaggcgaacagctgcacgtttatgaaatcggagggcgggcggacggctatgcttcattggctcctaatcatatcctttcagcgattgtgttggttgtattgggcctggttgggttcctgatattgaatttttatcccggccaggtttcaccggttatctatgtcgtgagcagtatgatactggttccaaatattgggtttgctgctgtttattttacacatacgctattctcaaaactgggggatatgtattccgtccgagcatttcaatatagcttattttgccttgctttactgtatatcaccaagttaaaagattcactgaatgagttttcaataaaaatgaggaaagagactgtacagtataagggatttcttcttttactctttaaaatttccgtacggtgtagtaaaatgcctcgattgtgggcgatttgtttttttcctgttttgcttattgtccaaatggtcctcatattatttggtcagcggccggacagctttatccgtttgtttttagatacaagttctttcacctattccaggatacccaatccccctccggaaatgttaaaaggagacgaacactatttatgttctgtggcagcgagggggcacacaaaagtcgttaagccggtaagggcagggctccggcacggcaaaagaattcctgtgaatcgccagttgctcgttgcgaatgccttcgaacatcttcttgaagaatacatgccgcgtatgcatcacttcatccgctatatttatgataaatacggttatcctctcagcaggcatatccgtacaaagtggtcagcggaccttgtctatcttttcatgaaacctttggaatggttttttctgtttatcttatatacagtggatcaaaaaccggaaaacaggattcagattcaatatagcgaattgcgtaaataacgatcatcatcgttttatatctgaacccggttcgtatcaaccgggttcaatcttggtgtccaaatgccagtctgcattttcatcgggacgcaaagcctgaattaagtataaatttaacgcctcaagctgtccgcctactgccactctttctggttcttccacttgagccattaaaatcaggccgtcccatatgttcaccataaaattgacaatcgtttcaagcggctgtaccggatgaaattcaccctgttttacgccctcttccagaagcgctaaaaagcttttcatggcccgggtataccttttttggaaaaatgcctttctttccggattgcgccacctggtgacagagtattcatacattacgatcccgtaaggatttggcaaactttggcaaaccactttctgataggcttgaatggcatcccatattttttcgtggctgcctgccaggtcttgaatatacgtataaaatgaatcgtcatttttttcaataaccgcctgcatgatttcttctgtgttggaaaaatactgatacagatttcctctgctaatgccggcttcttttacgatatcctgcatggtaacaggttcatagccttttcgttcaaacacccgcttcgcagcatccaatatatgattttttctttcttcaagatgttgttttgataccctcggcgacatgaatttccttcctttctgcttttttcattgcgattgcggaaacggcagcaagcaggcaagtggttccgccagagatcaggaatgcgagacggacgccaaaccactctgaaagcgagcctccaagtaatatgccaacaagcacagcgagtgtagaaaggctgttgatggtaccgaacactcttccggtatgcgtttcaggcgttttcttttggacgagcacatcgaaaggaatggcagccattgtaaaagaaaaacccatcagaaaaaagacgcaagggtaaacggcttcaatgatgccgatcggccagccggtacccgtacttaccatgatacaacccaaaccaagtatggcggggctgatttttaaagtgattaatttctcccctaactttattttcgtaaacagcacggaagcagtaagcatgccaaaaccgcttgccgcaatacaccagctcgcaaaatggaccgttgcgttcttgatatcccttattaatatcatggcctgggaatcagaaatttgcaaggccagtatcatggtacaaaaaacgatcagacccatttttaacacgggaaaaccggagagaaagcgaaatccttcagttagcgcgaccttttcccgatgttctagatcactttttaccgggctctgtaatgttggcgccttgattccaaacagcaggagggcggagaggaagaaagaaatggcatcaagataaaaagcgcctttgattccggtcaggctgatcaatgcgccgcctgctaccggcccgatgattttggcgctgttattgatcatctcgcttgtgccgattgccgcctgtatttggttttcaccaacaacttggcgaagcaggccgctttctgcaggggtgaagacggctgagaaaaagcccaaaaaaaatagaaagatataaacttgccaaagcgaaacggaaaaagcaatcccgagcacacaaccgcagcgggcgaaatccgagaagctcatcagcattttacggttaaaccggtctgccagccagccggcaggggatccaaataaaattgacggcagcaccatgcataatgtaatgcctgccattgcaatcgggtcggcgtgccacttaaatgccactaatgcaaacaatgcaacaagatgcagccagtccccaagatttgaaatggtttgcgcactgattaagaacagaaaggaatgatttttaaaaagcggattttcatttatgctcctccttaaatgacatttgtgtcgtttttattattataagcgacatgaatgtcatttaacaagatgattttaaaatttttcataaaattgggtgctttttgtgagttacaagcacgggaagagggggcgatgtggttgtttccgtcagcacttacaaccgcagccgttgccatataaataatggttaagcaaaataacatatctgaatggctgtctattcaatttacgatgacggaatgaagcggtaaatgagcttatatatcgtgagtatcatcatgattgaaaatttttgcggtttttttcgggatttttggaaaaacaggagacctgacttggagccgataattgaaccaatcaccatagaaaaaagcctgcaccactttacacaagcaaatagaaagcctataatggaaaaaagtgaatatttcagactactaggggtgcccggattggcgggctgagagaaaaacagttggtttttcaaccctttggacctgatccggatcatgccggcgtaggaaagtagggatttgtgaaaattttcttgcttattaaagtcaggtcttttacaggcctggcttttttctgttggaagggaggggaaaatagctgtttttagagcggtaacctggaaaagctcgccaatgaagacggacttgtgaggaaaagggaagaaatgaagatgaaaagaacttgccggaaaactgttttagcagcaaaaaatctaaatagttgaacgggctttggaacggtttgcagcttgtacatattggaagtttggatgaaaggaggtttcctaaatgaagtggcgaaaatggctgggggattacggacttttttgcgttacgatgctggtcttgatagccggctggcagtgggtcatacagaaagggatgatcccgtctttcattttgccgtcccctacccaaatctatgcatctttcatagaaaatcacaggcaattaataaatgtgcatttgccagcgacagtggaggaagtcggcatcggttttcttttatccgttgcgggcggagtgatgatcggtgtcatcatgtatgtttccaaaacggctgaaaaaatcttttatccgtttcttgttatttcgcaaacgatcccgcttgtcgccgtatcacctgtttttatgatgtggttcggttattcagtttggagcaaggtagcgatcattgtgttaacggctatctttccgattgtaatcagcacttttgacggattaaaaaccgttgatcccgcctatttgaatttgtttcggacaatgggcgccagccgctgggatatttttcgaaaactttctgtcccgatggcccttccccaatttttatccggcttgaaattatcggttgtatattgtgtcagcggggcagcgatcggagagtggcttggcgcaactgcggggcttggcttttttagcaagcgaatgtccggatatttgcagtcgggcgctgttttttcggctgtttttctattggctgcactcggcatgggattatttttgcttatttatgggatggaaaaaagcttattgaaaaacagaacaaaaatttagggggattttcaatgaagaaacgatggataatggtcgctgtgctcgcatgtttcctaggtgcctgcagcaatcattcgcagcaagcaacgaaacatgtgcaaaaagtaacgatcatgctggattggtatccaaatgcggttcattcttttctttatgtagcccaggaaaaaggctattttaaagcgcagggccttgatgtcagcatcaaaatgccttctgacacaaatgacccgttaaaacttgcggctgcgaatcgaattgatattgcattaagttatcaaccccaagtgttaatcgcgcgcgatgagaagattccggtccaatcttttggcaccgtcgtccgccatacgctgaaccgtgtgatggtgccggcttcaagcggcatccgctcaccgaaagacctggcgggcaaaacggtcggctactcttccattccgctggaagaagcagccgtgcggacaatggtcaaagcagacgggggcgatccggacaaggtgaaaacagtggatgttggctatgatttaatccctgctctgacagcccataaaactgatgcgatcgtcggcggttttgtcaatcatgaacagctgctgctggaaaaggagggcgtacccgttagagcgttcaatccggcaaaatacggcgttccggattatgacgaactcgttttcatcgcaaacgaaaataagctgaaacagcagccagacatttttaaaaaatttcttgctgctgccgaaaaaggccagcaatatgtcaaaaaacatccggaaaaggcgcttgccattttgttaaaacatgaagatgcctcctcaccgctggataaaaatgtggaaacgaagagcctgcacattttactgccgaagatggacgagaaaaataaaactattgccgatcaggacccaaaaaaatggcaagacgtttcggattggctgtaccaggcaaaaatcacaaaaacacatgtcaatcccgaaaaggcttttgtcaacttagaaaatcaataagaaaccaaaatgaccggaagtgaagacaacatttacttccagtagcgtttgaatacgaggaatccgggtgaatggggcggtaaatgttgacgtttgttaacaacttccggtctattcccgaatttcaagcaccgctccttcctgtaagaattcgaaaacatcagccgccttttgctgaggcagattaggagtagagaccgctgcacccagagcatgcctgggaagccgataaaatgtggtcgctttccaggaaaagccggcgcatggcccggccttgagcaatgaatgggactggttaatacaccatgctttcatcatgataatatttaaattcgagcaagttgttagaggggtcttggaggaaaaatgtccaatgttcctcttgcttgcctccaaaccggaccattttatcctggaaaaatggtaaatggtttttctttgcagattgaagggtttcctcaaatgctgctttatccaaaaaagtaatgccgaaatggcggggatacattttcgggttgggatctattttttcagggctcagatggcagacaacctggtccccgaaaaaattgaaagtgacccggtcatcataccggcgcgctaccttgcagcctaatttttgatagaaatcggctgtttcatcaagatctttgcacggaatcgccaaatgaaaaattttatccgtttctctcatgggaatctcctccaataaaaaaagtatctgatcgcaaaccgagccttaatgtttcaagcgcaagggcatccgaaaaagggatgttggccaaattggcatccggaccgagatggtggataaaaaaagcctggagctgcttgttgggcgcttcgaaaatgaaagaatcgcggggaatccccgagtccaggatggccgcaaacatctcctcccgtatttccccgtccccgttgtaaatgccgcttgtgccgctttcccttgcctctgtcatcactttatatgcgcctgcttctaaatcttgactaatcgattccaaccataatgctggcgtatcggccattgatttggcagtatcttttgagccgacttcacttaacactttaaaatcctttgaaaactccgcaatatagcggcatttttccggattggacagcggcagggtgccatttgagatttcaacatattcgcattcaaaccgccggcagtattgaacgtaccgatccgtttttccctggctggcaaacttttcaaataaagtgccgccgaaaaagaaggcaatgccgttttgcctcaggtgatctattttttcttccaaatggcgtgaaacgaccgatgttccccggccgaatttgacgaaatcaatataaggggctgcactgttcacggtatctttaaaaaagttcagcggaatgccattgtcaattaagatggtgatcccgcaatcccgcggtttctcattgcgtaaaggcagtgtcaaaccatggtcattcatcttcaaccctcacgatcgttggaaattctcccgttggatccattttcatcacaaactcgcagtctctttctttgatacaatattccaggtcagccgggttaaatgcaggctggccgggatcaagaaatttctttgcgacactggcatttacaatctccttgatcactgattccggctttatcgtgcccgagccggtgaggatgctttccatgtataatgcgcatgccaggtcatcttcccctgtcggatgggaagcgatcatgttgatgcgggcgttgtctttgtctttccatttgcgccggatccattttgccgtcgtttttgcattcgaaaagccggtaacatagacttcctttgcatgaagggcgcgaaaaactgcttttaccccgtttgtcgatgtttgcaccaacgttttgccggctaacggctgtttggcgatggcggccggtgaatggcccaaatcaaatcccgggatcggaaggccgttcctttcgcccgtgagcaaaacatgcgggtatttgtttttgatacgaaaagccgtttctattgagtcagccaaccaaatctcttttacgccgcccaaaaaggcatggtgggcaaccgtaaacgcgcggattacatcgatcacaatattggcgtccccgtcttccggcgtcatctcattcccctggtaaatgcggatattcatccattcccccctcattctgtgcaaaagatacataaagtatattggggggacgcttgatgcggaacttgccacccttttccttttttaaatgtcccatctgttcaaaaaagaattgactgtacctgcatttgattgtataatgttttcaatgatttctaaataatgattcgtgcttcttatccagagaggtggagggaaaggccctttgaagcctcggcaacaggttgaaaaacactgtgccaattcctgcagacaatcgtctgaaagataagagaagttgaccattgtgcgccggctcttcttatctttgtaaggagagcttttttcgaaggcgcttctcatggaaagaagcggattaaaatccaagtaaacttctatgtatatttggattaggatgtcatacataaataaacaaatgaaaagtgcatgcaaacattgcgaggtggaagatttgccgttaagtgtacaaaacagcccgtttagtaaagaacaggcggaaaagttaaatgaactgctgcaactattaacggatcagcaaaaattatggctgagcggatatttaacctatccgtttgccgaacaaggaacgaatcccccgggaagtacagctgttgccgaaaaaccggtacaggcggcaaccaaaacggttacgctgctgtttggttccgagacaggcaatgcccaggcgcttgccgaagcattcgccgccagattaaaagaattgcagtttaccgtctctttttcggcactcgatgcggctaagccgaaagatttaaaaaatgcagggtatctgcttatcattacaagcacacaaggggaaggggacccgcctgacaacgcattgtctttctatgagctcatccacagcagaaaagccccgaaactggacggggtccaattttccgttttggcgcttggggaccagacatatgagtttttttgcaaggttggaaaagagatcgacaagaggctggaagagttgggcggggaacggctctatccgcgggtggattgcgatgtggattatgaagaagacgcccaggaatggtttgaaggggttacaggcgtgctccagtcatctgccttgccggcttcaaccgctgccgatgccacccggcccgcaaacaccgattattccaaatccaacccgttccaggcggaagtgctggaaaatatcaatttgaactgggaagggtccaataaagaaacgcaccatatcgaattatcccttgaaggttccggttttacatttgaaccgggggacagcatcgggatttacccggaaaatgacccggaactcgtggaacggctgatcgaaaagctcggctgggatccaaaagaaccggttccgatcaataaaaaaggggaagtgctgccggccagggaagcattgctcagacattatgaaattacgagattaacaaaaccactgcttcagcaggcagccgtgcttttcggaaacaaagggcttacggctttgcttgaaaatgaagcggaggcaaaggcgtaccttgaaggtcggggcctgatcgatcttgtcgaggagtatccgccggaaaaagtggaagtgcaagcttttgtacaaatgctccggaaaatgccgccgcggctttattcgatcgcaagcagctggaaagcgaaccccgatgaagtccatcttatcattgcactggactgctatacagcaaacggaagggtgtgcgaaggggtttgctccggacaaatcgcaggcaggataaaaccaggagacaagctgccggtttatgtccaccgcaatccgaatttcaaacttccggctgatccggatgtgccggtgatcatgatcgggccgggaacaggcgtggcgccgttccgttctttcctggaagaaagggaagcggaagggatcaccggccgtacatggctgttttacggggaccagcattttgcgacggattttctgtatcagcttgactggcaaaactggctgaaaaatggcgtgctcgaacgaatggatgtggctttttcgcgcgaccaggcagaaaaaatatacgtccagcaccggatgcttgaaaaaagtaaagatttttatgcatggcttgaaaaaggcgcctgtgtgtatgtgtgcggcgatgaaaagcagatggcccgcgacgtccaagaaacgctgcttcacattcttgaaacagaaggcaacatgacgagggaagaggcagagggctatttgcaggaaatgcgccaagaaaaacgttaccagcgtgatgtgtattaacagagaggggtaggaagatggttgataaaaaacttgatccgcttgaaacgataaaagaaaaaagccggtttctaagaggaacgattgcggaagggctcaaagatccgctgaccggcgcgatatccgaggacgataataaactgttgaaatttcatggcagctaccagcaggacgaccgggatatccgcaacgagcggcgcaaaaagaaactggagccggcttaccagtttatggtgcgtgtccgcattccgggcggcgttgcgaccccggaacagtggcttgtgatggatgaactggcgcaaaaatacgggaacggaacgctgcgtatgacgacccggcagacgttccagatgcatggcattttaaaatggaatttaaagcaggccatccgcgaaatgaacgatgcgctcatgacgacgcttgctgcgtgcggggatgtgaaccggaatgtgatgtgcaacccgaacccgtaccagtcgggtgtgcatgccgaggtatatgaatgggcgaaaaaaacgagcgaccacttgttgccgcggacttccgcgtatcatgaaatctggctggaagatgaaaaaatcattgatacaaaagagcaggaagattccgaaccgctgtacggcccgaagtatttgccgcggaagtttaaaatcgggtttgctgtgccgccttccaatgatgtcgatattttttcacaggatttagggtttatcgccattttgaatgaagggaagcttgaagggtttaatgtcgcggtcggcggcgggatgggcatgacccatggcgatccgaagacatatccgcagcttgcccggatcatcggtttttgcaccccgaaccaggtgattgaagtggcggaaaaagtggtgtcgatccagcgcgactacggcaaccgcgcgaaccggaaaaatgcgcgtttcaagtacaccattgacgcacgggggctcgactggatcaaggcagaactgaatgaacggctcggctgggatctcggcgaagcccgcccgttccattttgaccataacggcgaccgttacggctggatccaaggcgatggcaaatggcatttgacgttatttgtccaaagtggcaggattaaagactttgacggctaccctttgatgaccgggctgcgcgaaattgcaaaaatccatcagggtgagttccgcctgaccccgaaccagaatgtcatcatttccaatgtaaccgacgaaatgaaaggaaagattgacgaactggttgaaaaataccatctgacggatggcaagcatgcttccgccctcaggagaaactcgatgtcctgtgtcgcattcccgacttgcggccttgcgatggcggaagcagaacggtacttgccggaactgctcggaaaaatcgaggagattttggacgaagcggggctgcgcgaagaagaaatcgtcatccggatgtcgggctgcccgaacggatgttcaaggccggcgcttgcggaaattgcttttatcggaaagggccccggaaaatacaatttgtatttgggtggcagcttcaccggcgacaggcttgcttgcctttataaggaaaatatcggggaagaagagatcctcgcgtcactgcgcccaattcttttgcaatatgcgaaagaacggcaggaaggcgaacatttcggggatttcgtcatccgtgccgggattgtagaagccatccgtgacggacgtgattttcataaaccggtagcggtaaataagtaagatgtgaaaagctgtgattccgaattttcccggggcacagctttttttgctgctttacaaaagattccaattgggacatactgtttagcagaatacatcgtaaagggtggttgccatgctcggaaaaaatttaaaaacgtatatagaaaaccaaaaggatactgtaataatattatgtaaacaggaactggcgtatatggagcgccataaggattttttcaaagatgttgccaatcaaaaagaaatggttgaaaaagagggtactgtccgttttgccgatgcggctattgaacggtgcaataaggaaaccgatgagacgcttgcagtggaaacggcggtgtttttaaatgaaactgtcctctatttgaaaaagcataggaaagaatatgtttacatcgcgtcggactggtttgacatcattggcgtcgacgggattgccctcgagctggatgatgtcttcggccattacaatagcatgctcgggcttaaagtgcaaaagaaatacgggccggcgattcaaacgggattgtctgaactgctcgaaggagacgggaagggggaaatcctttttgatggcaatgaaggcatctgggatgtgaactttccgttgaacgatgtgcccggtttcagggaagagatgccactcatggaagctttcgtgaaaatatacgaagtgctgtttgccttgcaggaaaaactcgaaaaaatgtcttgaccctcacgctgcgtcaccccttacagtaaagaagaaagggggctgcatgatgagaattaaagaagttgcagagctcgccggggtaagcatccggacattgcgccactatgacgaaatcgggctacttaaaccggccgaagtttcaccgtccggctacaggcactattcggaagaaaacttgaaaacgctccagcaaatcttatttttcaaggaattgggcttccctttgcaaaagatcaaggaaatcatggaaagcccttcgtttgacaggctcggggcgctcgagctgcagcgccatttgctgattgaaaaacagaatcggctcgggaacatgattgccttgatcgaaaaaacaatccaatcggagaaagagggaatggaaatgtccagtgaagaaaaatttgccggtttccgctttgacagcaatccgtatgcgcgtgaggcacgcgaaaaatggggggatcaggcagtagatgcagcagaagcgaaaatggcgacgcttggcggggatgaaaaattggctttggctgatgagatgaacgaaatttaccgtgaacttgccgccatccgccacaaggacccgcgcgtacaagaagcgcaaacagcgatccggaaatggtttgattttttaaaccgccatttcggggattatacgccggaagcctttaaagggcttggccaaatgtatatagaagacagccggtttacaaaaaatattgatcaatttggcacagggcttgcggcgtttatggccgcagccatggcggaatttgcgaatcaaacgcatcaataaaaaatgcaggagctgccaaaagggggctcctgctttctttttttcatttgccaccttgcaaatgaattggaaaaataatgaaacttgtcttacaataaagagaaagcatgacgaggaggtataggcatgtcacaaacgtatcagcaatatttaaaggaacaccatgaacagcacttagaagaactgtttgattttctccaaatcccgagtatcagttccctatccgaacatcaaacagatgtcagaaaagcagcggaatggctgaaagcaaagcttgggaaaacaggcctcgaacataccgcagtgatggaaacgaaaggcaacccggttgtatacggtgactggcttcacgcagacgggaagccgaccgtcctgatttacgggcattacgacgtccagccggttgatccgctgaacctctggaaaagcgatccgtttaaaccggagatccgcgatggcaaaatttttgcccgcggcgtgagtgatgataaaggacaggtgtttatgcatatcaaagcgatcgaagcattgatggaaacggaaggggaactgcctgtcaatatcaaagtgctgtttgaaggagaagaggaaatcggcagcccgcatctcgcaccatttgtagaagcacatcaggaacttttaaaagcggatttgatcgtcgtttccgataccggcatgccggagttgggaaaaccgacgatctgctacgggctgcgcggcttatgcggccttgaaatccatgtaaaaggcgcatcaagcgaccttcattccggcgaatatggcggcggggtgcaaaatgctgccactgcgctggttgaattgctggcgtccttccacgaccaggacggcagggttttggtggaaggcttctatgacaaagtggaagcaagcacgccggaagaaaaagaagcgttcgcaaaacaggcggcagatgaaggccaaatacaggcgcagcttggcgtaccggcattgttcggggaaaaaggctactcgtacgcggaaagaacatccgtccggccgacgcttgagatcaacggcttacaaagcggtttcaccggagaaggcctgaaaaccgttttgccgtctgaagcctttgcgaaagtgacctgccgccttgtgccaaaccaggacccgtacgaaattttgtcgttagtgaaaaaacatattgaagcccatgccccaaaaggcgtaaccgtttctgtaaccgaatttgacaaaggttacccgtatgtcacgccgcgcagccatcctgccatccaactttgcggaaaagcgtatgaaaaagtgtacggcgtgccggttacctatacaaggggcggcgggtcgattccgattgttgcagaatttgaccgcattttaaacataccggtcgtgctgatggggtttgccctttcgtcggaaaatgcccatgcgccgaacgagcatttccatcttgaaaattttgataaaggcatccagaccatttgcacgtattggaacgagctcaaaacattgccgctttcataagataaggaggaatgccccgtatgcgggttttcattcccaaaatgctataaaaaggatgtgggagatgttgcgtccggtcttattaggggtatgtgccgccttctttttcgcggtgacatttgttttaaaccggtcgatggaactgtcgggcggcagctggatttggagcgcctccctccggtacattttgatggttccgtttttgcttgtgatcgtgcttgccaggaaaaattttcaagccttatgggcggaaatgaaaaagcatccggccgggtggttattgtggagctttaccggttttgttcttttttatgcgccgttatgtttttcagcagcctatgcgcccggatggctcgtggccggcacctggcagatcacgattttatccggttcactgcttgccccgttcttttttaaaacggtggagacgccgaagggcctgctgaaaatccgggaacccatcccgttccgcggcttgcgctggtcgcttgtgattttgctcggcgttttgatgatgcagcttgagcaggccggccggatcagcttccgggaaatgatgctgggtgtccttcccgtcattgtggcgacttttgcttatcctttgggcaaccggaaaatgatggaattgtgcgaaggccggctcgatacatttcagcgtgtgctcggcatgacacttgccagcctgcccttttggtttattctgtcattgtacggtttaaaagcgtccggcccgccgtccggaaaccaaatcgtgcaatcaggcgtggttgcggtcttttccggggtgattgccacggtattgtttttccgggcaaccgatcttgtccgcggcgatatgcaaaaattatcgcttgtagaagcgacccagtcattggaagtgctgtttgcgctgttcggggagatggccattttaccggttgcggcgccatcgctgttgtcctggttcggcatcatcacagttgcagccggcatggtgctgcacagcctgatgtcacgaaaaacggtagcaccggctgcatggaaaatgaaaaagtcagaaatcagcggataagaaaatatgggaaaaaatgagacaaaatgagacagctgtcccggtttgtctcatttttttatgtgccgggcagacgaagcaggatgaaagcggggttttcaattggcacgctttttgcttgtttaccaagtgaaagacgacgataaggaggatggataaatggagacagtaaaagcgggcgaactgcagttaacgaaggaaaaagcgcagtggatgttgcaaaaaatgtttgaaatccgcaagtttgaagacaaagtgcatgaagtgtttgcgaccggcattttaccgggattcgtccacttatatgccggcgaggaagcggttgcagtcggcgtttgcgcccatctgaacgatcaggatatgatcacaagcacacaccgcggccacggccactgtatcgcgaaaggctgcgatttaaaagggatgatggcggaaatctacgggaaagcgacaggtctgtgcaaaggaaaaggcggttccatgcatattgccgacctcgacaaaggcatgctcggtgcaaacgggattgtcggcggcgggttcccgctggcatgcggcgcagcattgacggcgaaagttaaaaagacgagtaatgtaagcgtttgcttctttggggacggcgcgaataaccacggtacgtttcacgaaggcatcaacttggcagccgtatggaagcttccggtcatttttgtggcggaaaataacggctatggggaagcgacgccattccattatgcgtcaagctgtaaaacgattgccgaccgtgccgttgcctacgacattccgggtgttcgtgtcgacgggaaagatatcgtcgccgtgtaccaggcggcaaaagaagcggtggaacgcgcccgcaacggggaaggcccgtcgctgattgaatgcgtgacgtaccgaaactacgggcattttgaaggggatgcccaaacttataaagcagaagcagaaaaggcgaaacagctgaatgaaaaagatgcgatcgtccaatttaaaaaatttgtgcttgaacaaaacctgttcagcgaagcagacatcaacagcctggaacaaaaagtggaacaggagatcgaagaagctgtgaaattcagtgaagaaagcccgtatccggacccttccgaacttttgaaagatgtctatgtatcctactaatttatgaaaaaaggaggcctttccaatgggaagacaaatttctttttcgcaggccattaacgaagcgatgaaactggcgatgagaagagatgaaaatgtaattttgatgggggaagatgttgccggcggtgcggaagttgatcacctgcaggatgaagaagcatggggtggcgtgcttggcgtgacgaaaggccttgtccaggaattcggccgcgggcggattttggatacgccgattacggaagcgggctatatgggggctgcgatggctgctgcttcaacaggattgcggccgattgcagagctcatgttcaacgattttatcggcagctgtctggacgaagtgctcaaccagggcgcgaaattccggtacatgttcggcggcaaggcgcaagtgccggtgacggtccggacgatgcacggcgccggtttccgggcggcggcccagcactcgcaaagcctgtatgcgctgtttacgtcgataccgggcttaaaagtcgtcgtgccgtcaacgccatatgatgcgaaagggctgcttttggctgcgatcgaagacaatgacccggttatcttttttgaagataaaacgctttacaacataaaaggggaagtgcccgaagattactatacgattccgctcggtaaggcggacaggaaacgtgaaggaagcgacatcaccattgttgcagttggcaaacaggtacagacggcgcttgaagcggcagaacggcttgccaaagacggcatcgaagcggaagtgattgacccgcgcagtttatcgccgcttgatgaagggacgattctccagtcggtcgcaaaaacaaaccggctcattgtggtcgatgaagcgaacccgcggtgcaatgtggcaaccgatattgcggcacttgttgccgataaaggatttgatgatctggacgccccgatcaaacggatcacggcaccgcacacgccggttccgttctcgccgccgcttgaagatttgtatttaccatccgccgggaaaattgtgcaggcggtatcagagctcttgggggaaccggtcgggcaataacggacagatagaaaggagtggttggcatgccggttgaagttattatgcccaaacttgggatggcgatgaaagaaggaaccgtttcacaatggaataaaacagaaggagaagccgttaaaaaaggcgacccgatcgccagcatcagttcggaaaaaatagagatggaaatcgagtcccctgcggacggcaatgtattaaaaatcaatgtgccggaaggaaagggcgtgccgccgggaacggtgatttgctatatcggaaacccggatgaagaagtggcggcaacagcagcccaggtgcaggaagaaaaaggagaagaagaaataaaggcggcccatcccgcaccgctcccgaaaaaaccgggaaaagcgcgcgtgaaaatttccccggtcgcgcggaaaatggcggaagcagcaggcattaaaccggaagatataaaagggaccgggccagggggcaggattacaaaagaagatgtggaacaggcaattgcatcaaagaaagaaagccgcaaacaggacagcctcatccaggcgccggcaggaaaagaaccgaagcacacaccggtatccggcatgcgcaaagtgatcgcagaacgcatgcatgccagcctgcaatcagctgcacagctgacgatcacgatgaaagcggatgtcacggaactattggcgctaaaaacgcaagtgaaagagacaatcgcaaaacggtacgacagcaaactgacgatcacggattttatagcaagagctgccatccttgccctcgaaaaccatccggaaatgaacagtgcgtttatggataacacaattgtcacttacccggaaatccatttgggcatcgcaacggcggttgaaaaagggctgattgtcccggtcattcgcaacgccgaaagcaaatcgctgatcgacttggcaaaagaaatcaaagaaaaaacagcggcagcaagatccgggaaactgccggcagatgagatgcaagggtccacttttaccatttcaagcctgggtgcaagcggcgtcgaattttttacgcctattttgaacccgccggaagccggaatattgggtgtcggtgtcgtttcggatgaagctgtttttatcggggacaaaattgaaaaacggagccggctgccgctcagcctgacgtttgaccaccgcgtgctcgatggggcgccggcagcggccttcctgcaaacggtcaagcaatatttggaagaaccggttacgatgcttttgtaggaaagaagggatcaggatggaaaccatcgggattttaggcggcgggcctgcgggctacgtcgctgccattacagcagcacagcagggtgcggatgtcattttatttgaacaggcgacactcggcggcacatgcttaaatgaagggtgcatgccgaccaagacacttttggaaagtgcagggcgctaccgggacattcgggaagcggacaaattcgggatccgggtgaacaaggaagcggtgtccattgactggcctgccctgcttgaaaggaaaaatgcgatcgtttcccggctcgtgcaaggcattcaatacttaatgaagaaaaacaaaatcaaaatcgtgcagggaaaagcggcattccagtcaccccatgttgttcttgcagaaacagcaaacggcacggttgaaataaaagcggaccagttcatcatcgcaacagggtctgaaccgagttccctcccgtttgcgccgtttgatggcaactggatcatcgacagcacgcaggccatgtctcttcccggcctgcctccatcgctcgtgattgtcggcggtggggtaatcggttgcgagtttgcgagcatttacagccggcttgggacaaaagtgtcgatcatagagatggccccacatattttgccgggggaagatgcagatatcgcgaatattttaaaagagcagcttgaaaaagacggggtggacatttatacatctgctgccgtaaaaaaactggacagtgataagaaatgcgcgctgattgaacaggaaggggaaacgcgcgagatttacggggaatacgtgcttgtttcaatcggccggaaaccgtctgtcaacgggatcggcctcgaaaatgccggggtggcgtatgaaaaatcgggcataaaagtcaatgaaaagatgcagacgaacatccctcatatttatgcctgcggcgattgtattggcggcatccaacttgcacatgtcgcttttcatgaaggaaaagtggccgcgctcaatgcatgcggaatggaggaaagtgcggattacaaagccgttccccgctgcatttatacgtttccggaaattgccggcaccggcctcaccgaaaagcaggcgaaagaaatgtacggcgctgtccggatcggcgaatttccgttttcggcaaacggaaaagcgatgatcagcggtgaacaggtcgggaaagtaaaagtcatcatcgagccggaatacgaagaggtagtcggcttgtccatttgcggcccgcatgcaacagaactggtcgggcagggggtattgatgctgaacggggaaatgacggctgatctgcttgagcgcttgattgccgctcatccgaccgtctcggaagccatccatgaagccgttttaaacgcacagggccatccggtgcacgtataatcattcccggcagtttcagactgccgggaatattcataagccctgtctacatattgaaaacgctttccatattcgattataatagaaaagaacatcacgactttcttcctgatgcgcaattttctatgatgagtcggagggatgaaagatggctgtatgttattggaatacgtggaaaaagtttgtgcaggaagggacattggatcccgagagaatcaacaaccgaatcgctgaatcgtggtaccgctgtaaaaaacgggatgtgaacccgtatttgcggaaagggcagcatatcctgcctgttgaaaaactattggcacaccgggaaaggcataaagattttttaaatattgccgagcgccatgtgaaaaagatggagcctgtgtttcaggaagccggcatgatggcgctcctgattgatccttacgggcatgtgctgtccgtatcaggaaaccggaaaaccatttttgaagcgcaaaaaattaattttgtcgaaggggtttgctggacggaagagcgggtcggcacgaatgcgatcggcactacgcttgagacaggggaagccgtgatggtgaacggccctgagcatttttcggttgcctcccaccagtggagctgtgcagccgcgccggtttacgacagccaaaggaatcttgttggcgtcatggacttaacatgtccatataccgaatcccaccctttcatgctcgccatggtttcatcgctggcttatacagtagagcaggaaatcgtacgcatggcaaaaagccggcatgaacgtttcatccaaaaagctgttgaactttcggaccagtacggggaccggttactcgtcattacggatgaagaaggaaaagccgttgcggcaagccggccgcttcggaagaaaatgccggattattttggtagaacgattgaagaaatgacctcccaaacggataccattgtgaaccaatccattccattgccttccagccgggaaaaaatcggcacctgtttctttttgtctgaaaataaaaatctttccggcacccttcttcaaaaagaaaagttcgtcttccgtggcgtcaccggtataagtagaagttttcaggaaacgttgcgcaaagcccggattgcttccctttccgataccacttgttttatcacgggtgagaccggaactggaaaggagctggtcgcacgagccatccatgaaaacagcagccggaaaaacggcccgtttattgccgtcaattgcggggctgtgccgaaagaattaatggaaagcgagtttttcggttatgccgacggggcttttaccggcgcaaaacggggtggccataaaggaaaattcgagcaggcccatggcggcaccttatttcttgacgaagtggccgagctgccgtctgccatgcaaacggcgttgctccgcgtcctgcaggaaagaaaagtcgtgccggtcggttctgcaaaagaagtaagtgtggacgtccggattattgccgcgacccacaaggatttaccgaagctcgtcaaagaagggaagttccgtgaagatttgttttaccgcctgtatgtttttcccgtccgccttcctgctttgcgcgaaagaaaagaagacttgcctgctttgattcagtatatcagcagaaagaaaaatcaagacgtcgaaatcccgccggcggttatgaagaaaatgcaggattatcattggcccggcaatatccgtgaactgatgaatgtgattgaaaacgtccgactgcttgctgtggccggtgaagaagaagcggaacggtatgtggacgaatatgtttccggagagaccgggcttaacggcatggaaaaacaggtcacgacgctgaacccgcgggaagcgattgagcgcgatatgatactggaagctttgaaacatacgaaaggaaatgcggcggcagcggcgaaaatgctggatattccgcgcagcacattttacagaaaactgcggaaatacggcttgtaacgattgaatgcccggtttcagggtatagaaaaaatatcatcttggaaccgggtggttatgttgttggatacagtatggaaagaattctcggacattcatctttttcgttttgcgcttgatacggtcgttttgcttgttgccggcaagctgttgaagtggacggtatccgtgcttgcaaaaaggaaccgccggctgcaaaaaacggtcgtgccggcggtttattcaattacaaactgggcttgtttatacggtgtacttttgatcttcctgtttgatttctccgataacaggtggttgttttacccgctttattccaaaggcgggctcgatgtcacgccgtttttgctgattgttgctttaatgattgtcacgctcgcgcacaggcttgtgaagcttctgacaaaatatgtgctttcaaccgtttatgaccattatcacgttgaccgcggactcgggtatacgtttaaccgcctcatttattataccgtcatgattgctgcactttgtatcagctttacaacggtcggccttgacctgtctgcacttggggcggttttaagcgtaatcgggatcgggctcggctttggcatgcgcaacatcgcggcaaacttcgtatccgggatcatcattttatttgaacgcccgattgaagtcggtgaaacggttgaaatcaatgaggaaaccggcagagtggagaaaatcaatctccgctctacaacggtccggctcgataaaagcggtacgctgattgttccaaatcaatattttattgaacaggtcattaaaaaccggacgacggaaaagccttctgcttctattcaggtcagcgtcagttccgaaatggatacaaaaaaggtggaaaagctattgcacgaggcttttgaaacagtaaaagaagcagatcatggtctcgcaccggatacgatagcgtctgtaaagttgatccggttgcggaaccatagctttgattttcttgtagagatcccgcttttgccgggcaaccagaaagatgagattgaaaatgaaatgcgccatgtgatcgtccggctgttccgcgaaaacggcattgaatttgcaaaagaaccgatcgaacaggtgattttgcgggacagttgagcccagcccaaaaaggcaggtacttatggcaccatctgcctgattggcggcatcatgcatacgattaaaaaaagtgaaaaagtttgccccagttcctccgaaaagttatgcttatggtaggaggggatggatttggcaagttttacagagaaaaaggattcatgcgacttcacgaaagtggcggaaaatgtatggaaactggtcgtccgttttccattcggcatgcgggaggtcaattgctatctttttaaaggaaaaaaagggtacacgattgtggataccggggacttccatgaaacggcgaaggaaacatggaacaaagtgctggcatcggtttttcccattgaaaaaattgtgctgacacattcgcatcccgaccatctcgggcttgcgaaatggctgaaagaaaaatacagtgtacctgttttcatgtccgatttaagctttcagaccatgcaggaaacaaaggcccgttttgccgtttcacatgataaatacgaagcggttttgcaaaagcatggcgggccgactttgccgaaacggaattttgcacgggagatcccgaaatatgattttgaaccggacggcctttttaaaaatggcgaacaggttctgctcggtgatgatccttacgaagcgatccggacgcctggccatgcgccggaccatttttgtttttacaatcgcaaaaagcaaattctggtgctcggagaccatgtgttaaaagacttgtcccccattgttgccgcctggtctgagaacgacaaaaacccgcttggggattattttgattcgcttgaccggattaaagacctgcctgtcaaagtggcgcttccggggcacggcgggctaattgaggatgtaaaggcgcgggcggagagcatccggatgcgccatgagcatagactcaagcaaattgtcatgtcgcttcaagaaggagagaaaacagcggcgcaaatctgccgggatacttatggggatatggcaataaagcaatttttcgctccgtttatggcaacaattacaagatgtctttatctggaatttgccggaaaaatatcgagccgactggtgaatggacaaattttatattttttgccctgatcagctcgcatctgcttcagcttaagaggcagatgatttttttgcgccgaaggaaaagacgtgcagccggtaaaccaaaaaccggttgttcaagtttgcgcagaaggtatggctttagacgggcgataaatatagggcaagcagaaaaccgggcttccgatttccctacatatataggaattggccttgaaaggttcggaatatataattagttgtgaaagccacttttacaacaaggaggaaccgcatggaaaccgttgacgaaatttttcaaacaattgatgctgccttaaagaaagatccttcccggtcacaaggaatgaatgcggtataccagtttaatttaagtggggaagaagaagggacttaccatgtcgttatgcgtccggaaggcagttacgctggggcgggggaagcggaggatccgaattgtacgctctccatgtcatccgctgactttaaaaaactggtgcaaggcaaaatgaacggcacgacggcttttttaaccggcaaactccggctgaaaggggatatggggctggctttgcggttgcaggacgttttgtcagcatataacgcttcctgatggaaacaaaagaagcgaaagccctttacaacaccgctcctgggatccgttttgaaaaagggaaaccctggtgtggcaagggattcccgctcgcttgggtgtgccggcacagaagttgaccggattttttggcggaagctgataaaccgagcaccatgcctgccggttagaggcacgacaggaccgttccggcatggcgcacctgacaaggagatgaaaagatggcgcatgaacgttttcaaaccgttgagggtcaaatcaactggaatgacccgatgtataagctttatgaaaaagcaaagcggaacggcgggtggaatccggctgacattgatttcagccaagaccgggaagattttctccaattaagggaggaagagaggatagcatcgttaccgcttatttcctctttttcagccggggaagaagcggttacgctcgatattttgccgatgctccatgcgatggcaagacagggccggcttgaagacacgatgtttttgaccacctttttgcacgatgaagccaaacatacggaaatgttttcgcgctggcagcaggcagtgggcgtcggcgatcttgatttatcggcctaccataatgacagctacaagcggattttttacgaagcgctgcccgaagcaatggagcgcctgtatacagacgattcgcctgaagaggtcatccgtgcggcgacggtttacaatatgattgtggaaggcgtgcttgcggaatccggttattattcgttcaggcagatttataaaaaatccggcttgttcccgggcattttacagggcattgattatttaaatatggatgaaggcaggcatatccagtttggcatttatacgatacagcggcttgtagttggaaatgaggaaaggtttaaattgttccatgactatatggatgagttgtggatgcatgcttacggcgttgtcgaataccttgtcggactggcggttttacaacgggaacagtcaaattttgaatcgcagattgtattcgagccggatataatgcggcaatacgctgttaaacagttttatattcgaaaaagcaagatcgaccgggccagaaaatacaagaaccttaccgaattggaagctgctgcagattcctaaaacagaagaccccgggcccggggatccagcgggaggacaaagtaagtttcccggtgaagcggcatggatgtggaaaaacggcggcagctgcgaaacatctgtaaaaatgtctctgcttcccggttttccagcacgtaccggcccgggcaaaaaagccggcatgctgtgcgaaacctcaatttaccaggattgtcactttattgcccgatttttcgctatcatatgaaatgcttttccattctgttgctgctttttcgtacgcttgttttgtccgctcgtcaaaacacaccatccacacttcctgcaccgagtcggaagtttcaaggaatgtacaaatggtgcggacagcgatccgggcagccgcatccagcgggaaatggtatacaccggtgctgatggaaggaaaagcaaccgttcgcagtcctttcgattcagcgaggcgcaggctgttttggtaactgttttccaataattcggcttcatgatggccgcctccctgccagacggggccgggcgtatgaatgacgtattttgccggcagccggtatcctttcgtcatttttgcttcgccggtcgggcatccgttcaatttccggcattcctcaaggagctcgggccctgctgctctatggatggccccgtccacaccaccgccgccgagcagtgttgtattcgccgcatttacgatggcatccgttttgacttttgtaatatcgccaagtacgattttaaaagacttcatctccatcatctccgtttctgttctttgttttattttaacaggaaggggtggatgtttaaataccggtatagtttcacactcccctatccatactttaattgtaaaaagaaacggaggttttggtatggatgcaagacgtgcgcaggaaattatgaatgtgccagaaatggtgacggtcactttgaacggggaaaggatttacatcgagcatgttgaccggcaggaagaaacagcaacggtgcatacccttgatcatccggataaaaagatgagcgttcccgtcaaccttttgctggaacattaaaaccgctttttgagcggttttttttcggttgacagtgaaaatacaaacatttagaattttagatacggaacagatcttcatgggagaggggtttagtcaaatgaatctggaaaacagcacagccattgtaaccggcggggcatcagggctcggggaagcaacggtaaggaaattggtggaaacgggcgcgaaggcggttgtttttgaccttcaacaggaaaaaggagcaaaattggagcaggaactaaaagggcgggttcgttttttcaaaacggatgtaacggatgagaaaagtgttcaagatgcgctagaacaaattgaaagcgttaacatactggtaaattgtgccggcatcggagcggcgaaaaaaacatacggcaaaagcggcgtacatgatcttgcctcttttcggaaagtgattgaggtgaatctgattggcacgtttaatgtgatccggcttaccgctgaaaaaatggcacataacagcccgaacgaagaaggggaaagaggagtgatcattaatacagcctcggttgccgcttttgaagggcagatcgggcaggcagcctacagcgcgtcaaaaggcggcattgtcgggatgacgcttccggttgccagggatcttgccagccttggcattcgtgttgtcacgattgcaccgggtgtatttgaaacgccgcttttcgcttctttgccagaaaaagcaagggatgcgcttggcaagatgacaccgtttcctccccgtctcggacggccggcagagtatgcgcagcttgtccaaagtattgtcttgaatccgatgctgaacggggaaacgatccgacttgacggtgcgatccggatgcagccgaagtaatgtgaagctgatgatggaaaaatccgcctggcaggcaggcacgggaaacatctcaaaatcgcacgcgcaaggcggattgggccggttgcttaacgggtcgataaaaacagtccgggccgggcaccattttcaaaagagtcccgtgcaaatgcgagactaagacaggaaatacgggtttacaagcggaatcgcagtttaaaaacgcagggtataagatgaatggaatatttttatggtgaggggaatgcggatgcgggaagcggtcattatagaagcggttcggacacccgttggaaagcggaatggattattaagcgggatccgggcagaagagctggcggcgaaagttttacaggaagtggtcgaacgggcggggatatctccggatatggtggaagatgtgatcatgggctgtgtttcccaggtcggggaacaggcgtctgatattgcgcggcaggcaacgttgatcgcaggatttccgattgaagtgcccggcgttaccattgaccgccagtgcggatccagtcagcaggcggtgcattttgcagctcaggcggttctctccggcgatatggatgtggtgattgcaggcggggttgagagcatgtcgcgcgttccgatcggctccaacaggaacggcgccgcattcagcaagttgctcactgcaaaatacaacatgatccatcaggggctgtccgcagacttgattgcggaaaagtggggcattagccgtgaaaagatggaccactatgcgcttgaaagccacaggcgtgcattgcaggcgcaaaaagaagggcgttttgacagggagatcatgccggttgaagcggaacagcctgatggcaagaccgtgacagttgtgaaagatgaaggcccgcgttcagatacatcgattcagaaattgtccgcgctgaaaccggcttttcaggaagacgggcgtatcacggcaggtaatgcgagccagattagcgacggggcagctgccgttttaatcatgtcccgcacaaaagcagaggcacttggcctgaagccgcggttccgaattctcgcccggaccgttgttgggtctgatccgacactgatgctgacaggggtgatcccggctacggaaaaagtgttatgtcaggcggggctttcgattgatgacatcgatgtatttgaagtgaacgaggcatttgcttccgtaccgcttgcctggcttttagaaaccggcgccagtccggaaaaactgaacccgaacggcggtgcgattgcgcttggccatccgcttggcgcaagcggggcgcggctcatgacaacgctaatacacgaactggaacgaacaaacggccgttacggcttgcaaacgatgtgcgaaggttacggtatggcaaacgcgacgatcattgaaagattggattaaaaaacatgttgtttccggctggggaaaggagcgtatcaccgcagccggcgctttactgcggcaaacggaaaaaccgggtttttcgaacaggaggagtaaaaatgtttgttgggcaacagctcaaatggcatgccattcatcaaccggaccatatcattacgtcttaccggggaaagaaaatgacttatgctcaattttaccgggaggcgataaatgtcgccggctttttccaaaaaaaggggtacaaaaagggagacattattgccctttttcttcataattccgatgtgctgctcattgcctattatgcctgccaactgggcggtttcacagccatgcctgtcaatacaaaattggcaccacccgaagtgcagtatatttttcatcactcagaagcaaaagccctcatctatgatacccgtctgctccatatattgcatgaaattccgcgcgagtttcatcaattccaagaccgcctgatggtcggcggggaagacacattccgggctattgccggagaaaatacggatgcttttatgcctccccaaatagaggcagatgatactgctgtgattttttatacatccggcacaaccggcaggccaaaaggcgtcatgctgtctgccgcaaatgtccgggcagcggcacaaatctgggctgaggcaatggatttaagcagggaagaccgtgtgcatattgtcaccccattattccattgcgcggcatgccatgtctttagcattccggccatctaccgtggtggcaccatgatcatagaagaacaattttcccctgagaaaacgcttgaaacaatggaaaaagaaaaagttactgttttcttcggggtgccggcaatgtacagtatccttctcaatacgccgaaaatggctgaagttgacctgtcttatttgcgattgttctgttatggtgcgtctccgatgccgtatgaacgtgtgcgccagttaaaaacgcgttttccgacagtaaaagtacaaaatttatacggccagaccgaaaatgcgccggcagcttcaacattaactgaccgttttgctatggaaaaggcaggttcggttggccaagcattgccgcaaacggaaattcaagtggtagatgcgggcggttcacctgttcccgccggggaagtaggcgaaatcatcgttaaagggccgcaagtcatgaaaggatatttgaaaaatgaagaagaaacgcggagggtattgcaaaacggttggctttacagcggagatttgggctatttcgatgaagccggctttctgtatttagttgaccgtaaaaaagatatgttaatacgtggaggcgaaaatgtttatccggtggaagtagaggaagtgctgtatgaaatgccggaaattttggaagcggcagtagtcggaattccgcatgaaatatacggggaagtgccaaaagcctatattgtcgtgaaaaaaggcgaaacattgacagaagaaaaagtgtttgcctattgttcgggaaaacttgcaaaatataaatggccggccgaaattgaatttttacagacgcttccacgaaatgcgagcgggaaagttttaaaacacgttttgcgaaaacaaatttccggggtgtaaggcaaacagcacggcagcaaaaaatacccattttgagaaagggcgcccgtgccgtttgggaaaagcgtaatgccggcaatgcgccggtatttttttgtttaatttggtttaataacactatgtgctaaaagataaataacttttgaccaaatgtttgcacgataaaaatgaacgaatttttaccattcttttgccggcttagccggatgcacggttgatataaaacgcgactccattttatagaaatgaaagggtttcagagcagatttcataaaaattacacaatgtgctaaaaacacaataaaaaaacaaaaaacctacaactaaaataacatacgttcgagtgttattttttgtgtgctgccggtacattttactataatggaagaaaaaggggtgagtagcatggcggaaaaacggcaaagggagagtaccggctttttaatcaaacagcgcgcctttttaaaactttatattatcaccaatattgaaaacggacggtggtacgggctgcagcttttggatgaattgaaaaaagaatttaagccgctcggtttcgaaccgcagcattccgaaatctaccgggcgcttcatgaactggaagatgaggagcaaattttgaccaaaataaaagtaaaaccggacggggcaaaaagaaaagaggttgttgtatacaaaatcaaagacatggaaaaagcaaaagcgtacaaaaaacttgtcaaggctgacttggaacggtgcgagcagctcttgcgaaaagcgcttcaagataatttttcataaaagaagccggggttgccggctctttttattcatttttcactgctaaaacggacgctcccccttatgcttgatcgatcaccccgagcatttccaaaccatggtaaataccggattcggtaacgcttgtcgtccggtgttttgcataagcaaacagtccggggttgctgtttgccatcgcaaaactttcgccgactgtctccagcatttctttatcgttcatgccgtccccaaacgcaacggctttttcttttggaatgccgaggatatccagggttttggctacagccatgcctttattcactttatcaagaataacgtcgtaacaatgcctgaatccatcaatgttgacctgggataaatgcaggccgggcaaatctgcatacaatgcggcgccgtttccccggacattcacaagcgtaatgcccaatacttgatcaagtactgccggtgtaaaaggggcgttttggcgaaggtggattttttttataaaacttttcacttcaggcacatcaaaagaagtgataaagttttgccggtccgtatacaaaacgacttcatgtccgtgcttttcggcaatgccaataaatttatcgacaattttagggtccattaccgttttaaaaaggttttttcctctatagacagcaagtgtgccgttatagccgatcgcggattcgatttccagttcgtccatcagccacgaaatttcatgaagcggcctcccggttgccaggaagacttccatgccgtgcttttttgctttgaccacggccttttttgttgaaggctggatcgtatcttccggtgtcaaaatcgttccgtctacatctaaaaaaagtgcttcatagtgtcccatcatttcgctccagtatgtataatttttcacttttactttaccacaaataaaaatgaatgtgaaaaacttcgctattgttgtttgtctaccaatcttcatgctatcatgaaagcatatgattacagaatataaaatgcggggtgcatgaaaacatgaataaagggaacagtccttcttaccaaccgaaaagtgataaaaattttacggcgctgattatcaccgtttcccttatcgcaaatattatcattttgctgctcttttttacgaacatcggttacaagggtaaagtaggatttgatatttatattttgccgaggatgaacgccgtttttaacagctttacgtttatttttctcgtctgcgcgctcatcgccattaaacggaaaaatatcaatgtgcatagaggatttgtactggccgcttttgcgtcaacgtttttgtttttgctttcttatttgacattccattatctttcgcctgaaacggcaagatatggcggggaaggggcaatccggttcatctatttctttatcttgattacccacagttttctcgcggccattattgttccgcttgctttgttcgcacttgtgtggggatggacaatgcaggtgaaaaagcacaaaaaaattgtccgttgggcgatgccaatctggctttatgtcagcatcaccggcgtgatcgtttacttgatgatggcaccgtattattaaagaacagtacaccagccgctggtccggttggtgttttttttgtgcaacttttgtcataaattcttgttttttatcgaaaataaaaggctggacatgtataataatagggtacaggaagaagatttttgaaggaggggtacatatttgatggtctggacattggtaattttatttgcggtatccgttgtgttgctgatcatgtccatctttaaaacgcggaaccgtgcgaaagaggaacagcaggaattggaaacggtgcatttggcactcatggatgaaatcaatcatctgaaagacggcatccggacgcttgaactggaaatggacattcttgaaaaagaagccggcatccagctttctgcctttgataaacagttcaggcttgaagtgctggatttatataaacgcaactactctattgaaagcattgcagaaaaaaaacaagtgacaaaagcggaaattgaggaaattctggccccgtttatggcggcgcaaaacgaaaggagcaaggttgccggtgggaatgaataaattgagcagctttgccgcagggattttgctcgccacggctgtaacaggcgccgtttatttttccgaaacaggcaaagcagcggacaatacggtgaaaaaaacaaatacggctgaaactgcaaaactctccaacagccagatgaaagacaaactagagcatgcaggatatgtcgttcaaaccaaggctgcatatgacaaagatctggctgatgcgaagtcatccgctgaaaaatccgcgaaaaccaaaaccgtcaaccgggttgtgttccaggtgacggatgggatgacgagcattgatgtcggcaaattgcttgagaaagctaatatcgtggatgatgcatttcaattcagtaaagatgtcgaaaagaagggtgttgagaatcatcttcgccctggtacttatgtcgtggacagcacgatgagttacgataaagtgatttcaaccatttttaaaaaataatcatgaagctagctgcctgccgtactgcggaccgggcagctttttttgcgccgtttttccggtttacgaaattttcactgcaatagtatgattttaaatgttaaaataaagaaaacaaggagggaagacaactgtgaaaaagacaaaattagtagttgcaggcgttgggcatgtcggttcgtatgtgcttgcaaatgcgatgaaactgggccttttttcggaaattgctgtattggataaaaagaaaggggtcgcatttggggaagcgctcgattggagacatgccacggcacttacatatatgccaaacacaagcgtgaaagcaggggattactcggaatgcgccgatgcggacgtcattatttgtgcagcagggccaagcgtgcttccgtcggaaaaagacgaaatgccggaccgggcagggcttgccaggacgaatgccgccgtggtgcgggaagtcatggcagggattacgaaatatacaaaagaagctgtcatcattttcattacaaatccgcttgatacgattgtctatattgctgaaaatgaatttggctatccgaaagggcggatattcggaacaggcaccatgcttgattcggcccgcctccgccagattgttgccgaaaattacagcattgatccgaaaagtgtaacgggttatatgatgggcgagcacgggtttacctcatttccggtttttagccgtttaaatgtacagggattccgtgaaaaagaactggacagcgtgtttaagggaaaagaaccgttggacagggaagctttcagacaaaaggtggtgaaaaccgcttttgatgtcctgaatgggaaagggtggaccaatgccggtgtcgctgaagctgcagtgacattggcaaaagccgtgatgctggatgaaaaaagcatttatccagtttccgccactttgcatggtcagtacggatataatggtgatgtcgctttaagcataccaagtgtcatcggccgtaacggaatcgaacaacagcttgaaattgaactcgatgaacaggaaacatcctggctgcacgaatcggcaaaatcgatccaaaatacaatggcatcggtaaaaaccggaaaatcgtatattcaggcttgatctaaaaaatccgctgcattatacagcggattttttaggtgaaaacgattctggccaaagataatctctgggtacaagggaaaaggagtggccgggcaactccgcaatgtgatgatttttatctagttaacataatatatattatagctagttgaggagtaaaacgaaattttgtctcaaaaaagaagattactttaaacattgagacagaaacaatttttccgtgaaacacaatctttattgcatcttttcatctcatcaggatttcggtttgtccggtatgcgtttcattgatcgttccaggtttattccatcactcagggttgttgcgttttcatctccagttacattttcgcacatgctttcattgaatcatctaatcttggtttgttcttttatttgcaatccctgcacattcttttgccttaaaattcttcttctggctgattttcctatatttgtgcatgaatgagcattcctcatcggtttcatttttcgcctgccttttctttaaaataactgcaagtgtttatccttttttgatggttttaaacctgtctattgatataagtcgatttttcgaactgttctttccttttattgtaaaccttttcttgcggtgatacactaaaaattgtaaagaaaagtaaacgcatactttttctaagaatatatccatcaggaggcatgcatcatgtcaggcagagttgcagtgattacaggcgccggcagcgggattggccgggaaaccagtttaacttttgcacgtaaaggcgattccgttgtggttaccgatattgatgaagaaaaagggcttgaaacggtggaattgatcaaacaagaaggcggagatgctgtttttgccaagacggatgtttccaaattcgaagaggttgaatcacttgtcaatcaggcggttgaaatatacgggacgattgacgtgatgttcaacaacgctggaatcggcacgctcgggcatatcctgagcctgaaaatagaagattacttgcgtgtcattgatgtcaatcagcacggcgttgcatacggagtcattgctgccggcagaaaaatgcgcgagctggatatcaagggcgttattatcaacacagcttccgtattcggatatttggccagcttcggtactttcccatatcaggctgcaaaaggcgcagtccggatgatgacccaaaatgctgcgcttgaactagcacaatacggtattcgcgtcgtcggcattgcaccgggcagtgtggatacgccgattatacaggcatataaagatgccggaatgacacaaaaaatgacagaacagcaaatgcgcaaaaaactgatccgtcctgaagccattgcaaatgcggtttatctattaacgcttgaagaagcagatgtcattaacggaagtgttgtcatgcttgatgacggctatgcttctttcaaataactttcttcatttgtttttttcacacgtcccctattcctccccgttccgttcaaaagggcctcctcccttttgaaccggatgtggatatccccctctctatttctttaatcttatggccacctgcacgaaaaagtgaaaatccaaacgctatacgatagcaaatgaaccttagcgcagcggttctttttgtcattttagtggcaaattatgttacaatattcatacagctctcgttgtgggtctggctgtcttcgtccactcctgggcgatttgaaagaaattacgagaaagtgggagtatgtatgggaagtcaatcatttacatcagcgccgttagaggcagaaaatcctttttttcgccgtgcgctgtttacgttcagcggtgcgcattttttaaatgacctggtgacaaccggcatggtccctgcccttgttgtcatgtacaagcatgcgctccatttgaattatacgcaatccactttaattgtgctggtttcttattttacttcatcggtcacacagccggtttttggcatactgacggaccggaaaccacgggtctggcttttttcgtttggtgtctttttatcgattgccggcctgagcctaaccgcaattgcgccatcactcacatggcttttgctttttattgcgctttccggattcgggtcaggcgtctttcatccggaagcatcacgcggcacccattttgcgtccgggtataaaaaaggattggcacaggcaatattccaggttggtggaaatgccggacaggctttcgggccgcttatgattccgctctttttggtacataccggcatacacggcctgatctggttgcttccggttgctcttttatcccttattttaaccgcccctttacttggctggatgaacagcaaagtgcaaaatatccagcgccggagaaaagaaatcgccggaaaaaaccatattcccggcgtcatcctgcttgttctggtcattattttgcgttcctggtgccaggtcggggttgtcatttttcttccgttttacatgaaacatgcaagcttggaaatgagcgaactattgaactttgtctttgtcggggccggggcactgggcacactttttggcggcatgatttcggaccgggccggcatgaaacggctgcttgtcgtgtccatgttccttgccacgccttttgcactgctgcttccgcatttaagcggctggctggctgtactcgatttgctctgtttcggtttcagcgtcctttcaagcttttctgtcggcgtgatctatatgcaaaagctgttgcctaaaaatatcgcgcttgcatccggcctgtcaattggtttcggggtcggcgccggcgggatcggttcagttttcatgggcggcgtttccgatatgttcggggttgccagtgtatttaccattttatctttcttgcccatgatcggtgctgttatatcctgcttcttgccaaacgaaaaaaggctcgcaaattaaaaagtggtatacacattttcgcatgtttcagctgtcggttcgtaaaaacaatgcaatttataccgggcaacgaacggctggtcgtaccatgtgggcgggcagtccccctgcggcctgaaataccataaactgtatttggcgggccaatgcctttcgccgttaatcgcacgtctggccaaccgccgttcgctttcccgtgcccgctggtaaaaatatccgtgaatcactgcttcaaaagcatgcggctgataaaccatttgcggaatggtccggagtccgataaaatccgaacaattcgccctgatccggtttacgccgacattgccgacaagcagcatgccaagctgcccctctccttctgcttccgcccttaaaagccgtgccagtaaatcgatgtctgcacttgatgcctttacgactgccattttaagcctccctgaatttgcaaattgcgcacaagtttcgctttttatcttatgccgcaaaacacaaaaagagaaccccgcctgtgtccggaataaatcaagcacccgggcggaaaacaccggatgcttgatgtttgttaaatcggaagagtaccgggctttaagtttgggcgcacggcacaaaagggcaatcggcagaaacggatcctgcaaattaaaaattggtttctaaaaataccggacagtggtcactgcccatgatctccggatacatgccggcatcttttaaacggccggccagtcttttggatacgagaaaatagtcaatccgccagccgatattcctttccctcactttgttcatataagaccaccatgtataagcgccttcccgctcaggataaaaataccggaacgaatcaataaatccgctgttcagcagcccggtcattttaccgcgttcttccgctgtaaacccagaattgccaacgttattttttgcattttttaaatctatttcctgatgggcaacgttcatatcgccgcatacaatgactggcttctttttgtcaagctccgttaaataggcccgcatccggtcttcccattcgaggcggtaaccgaggcgggctagatcgcgctgggaattcggcgtataaacattaaccaaataaaaatcttcatattcgagtgtcaaaatccggccttccggttctgtccgatcttcgccgacgccgtagcgcacggaaagcggctctttttttgtaaaaacggccgtgcctgaataccctttccgctcggcataattccaatattgataatagccgtccaaatcaagggcgatctgccctgcctgcagtttcgtttcctgcacgcaaaaaatgtcggcgtccgtttctgcaaaaaatgcaagaaaccctttttttacacaggcgcggagcccgttcacattccaagaaacaaatttcatccccggtttctcctccattgcatttaaaagttcagctgttttaatgcttgataaaccgcagcgacgtccgcttttccggttccgtctgctttcgcccggctgtatgttttttcggctgcatccgccagtggcagcgacataccggcttttttgatttcctcttttgcaaggccaagatcctttgccattaattcgagcataaatgcagccggaaaatcttcttgtaaaaatgccttctttttcatttggaaaataggtgtattgcatgcagaagccgaaatcatttcaatcagatccttcttttcaagccctagtttttccccgaagagaatggcttcggacgctccctcgatcgtcaggccgagcagcaaattaatcgataatttcgcggcactgccttttccgttttcgccaaaatgaatgatggtttttcctaatacttcaaacatggggcgcacagcatcaatctcttctttccggccgccggcaagaatgacgagattcccttcttttgcaggctgtactgaacccgataccggtgcatcaataaaatgcccgcgcttttcttccacccatttggcaaaacggatggaatcggaagggctgacggtactcatatccacgactgttttccctttcgtaaggccggcaagcaccccgtcctctccttgtaaaacgttttctactgccgcggcattggtcagcatcgtgacaatgacgtctgtattttcggcgatgtctttcggcgttttgcaaacggctgcgccggcttcagctagtttttccgttttcttaattgtgcgattatacacaaacaaatcgaaatgcgcatctaaaaggcggcgggccatcggagatcccatatgccctagaccgatccaacctatcttcatgacaaaagcctccatatttagacaaattcacctgaaaagccataagctttaaagggatattctgttcttattctaatgttaaagaaaaaatgcggcaagaaatacgcaatttttgtagaaatatttggtgtttgtattgaagaaaaaagcggtattatacaagtacaatcgatgttcgccaatccttgtgtggggggtgggaaaagtgaaaatcaaagtcggaagctggaatatgttaacgcttcaagataagttatcgattttaaaggccatcagccggagaaacaaacatgggcatcagtaaaaggcgccagtacgaagcaggcgcctttttccattttgtttaagagctccccgttctttacgggcataactcttcatacagccggatatatgcatttgcagaatgtacccagctgaaatcaagccccatcacccgttcagataacgactgccatgttttcggctggtagcggaaaaaccaaacggccctttcaatcgtgtacagcatatcgtgcgcgttatagtttgtgaacgaaaacccgttgccttcgcccgtgaattcattgtacggctttacggtatctttcagcccgccggtttcacgcacaagcggcaatgtgccgtaccgcatggcgatcagttgcccgatgccgcacggttcaaatttggatggcattaaaaacaagtcactgcccgcataaattttatgggaaagggcttcatcaaaataaatatgtacggatacctgacctggatactggctttcaagatgccggaatgcttcctcgtactgatgctcgcctgtgccaagaagtacaaactggacatttaaacttaacatctcatggatcacatgcagcaccagatcgatgcctttttgttctaccagccttgtcaccattgatataacgggaatgccggaatccacttgcaaatggaaggcttcctgcaaggcttttttattctttaattttcccgggtagtcctcatatgtaaagaacagtgcatcgtctgttttgggattgtaagcatccgtatcaatcccgttgataatgccttccaagcggttgcttttcatccgcaaaaagccgtcaagattttccccgtaatacggcgtctggatttcccgggcgtatgtcgggctgacggttgtaatggcgtctgcataagcaatccctgcctttaagtagctgacattcccgtaaaattcaagaccatccacatggaaatataattcgcttaaatcgagcagatctgacaggacactttttggaaataccccctggtagcgcaaattatgaatcgtaaacatcgttttgatgccctggtagaaaggatggctggaaaaatgcgcttttaacagtacgggaatcggcccggtttgccagtcatggcaatgaatgacatccggtttttcattcaaataaggaagggcttcaagcactgcacgcgaaaaaaaggcgaaccgttcgccatcatcgaaatagccgtaactcccatgccgtttaaaataatactcgttgtccaaaaaataataacggatccccccttcttccaatgtttcaatcccgcaatactgcttccgccatccaaccggcacggtcaggctggtcataaaggagaggcgcgctttcacttcaggctgtaaatcttcatatttcggcaggatgactaccggatggatccccgcttttttcaaagctttgggcaatgcctggatcacatcgcccaacccccctgttttaataaatggtgcgcattctgaagcagcaaataatacgttcatcttgtctcctccatcaaatgatctcttttttggataatactgtcggatgcgacggggtcccgacaaccaccttatgctgggtaacggctacctgcttgtctgcgatgacattttccaataccgcatcttcttccacttctgatttttgcatgatgatactgtttttcacgactgttccttttttgatttttacgccgcggaaaataatactgttttccaccgtcccttcaattaaacagccgttcgcaataaatgaattttttacgtccgctgtttgtccgtattttgtcggcggctcatgtttgatcttggtcagaatttcccagtcgctgtaaaagaaagcgcggatcgtatccgggtcgagcatggccatgtttgccgcgtggtaactgtccatggagtggataaagatcatattgccgcggtggtgataccccttaattttaaatttatggacattcgctttgatcgcatcccgcaaaaagtcatattctccgttttcataacaggtttggatgagatccatcagcaacggttttgacagcacataggtttccaggcagacaagatcacccttttgcggagcggtaaacagttcgatgtcccgtacgttgtcctctttatctaccactacttgatgatagttcggtttttggatcggctccccgtcatattttctgtatacaacggtgatatccgcctggcttttctcatgggatgcgaccagctcacaaatatcgagtttgctgacgttgcttcccggcgagatgatgacaaggtctgccgaggcccgttcaaagaattcgcgatgatcataaaagccctggatatcccccttcaattttgcatcatcggcaaccggcggcaggataaacagcccgccgtcgtaccggtccaaatcccattcctttccggaaccaatatggtctatgatcgatctgccgttgtctttcgtaaaaacggcaacctgggtaatttcagcatgaatgagattggaaagtgcaaaatcaatgaagcggtatctggcgccgaacggaacggaagcaaggcagcggtgttttgtcagctcctttaaaatcggcttttcattgatcaaattgataactcctagtacgttcgtcatgtttcacccgtccctctttataaaacttcttttatttccgcttcttcgccgttttgcggacagctgtacaactgaatatcatttggttttgaaggcgtgatttttttgccgttttcaatgacggtgccgcttgcaataatggcgcgttcgatggtcacattgctgccgatcgtgacattcggcatgatgacggaatcctggattgtactgtttttgccaatataaacatgatccgagatgacagaatggaaaacattcccgtaaatccagctgccttcgttgatgagtgcgtttttaatattggattggggcgcaatatattgcggaggatggttcgcatctccggtgaaaatgcgccagtccggatcatccagatcaaatgccggtttttcttccagcaagtccatatgtgcttcccagaagctttggaccgtgccgacatctttccagtaaccttcaaatttataagcatacattttctttttatctttcagcattttcggaataatatctttcccgaagtcgtgcgaggaagcgctgtttttctcgtcctgtattaaatattcgcgcaaaagcttccaattaaataaatacacgcccatagacgcgagattactctttgggaatttcggtttttcttcaaattcaacaattcttccttctgcgtttgttaccataatgccgaatcgccctgcttcctgccacgggacttcaattacggcaatactcgcctgcgcccctgcttccatatgcgattttaatagtttccgataatccattttataaatatgatcgcctgaaagaatgacaacatattccgggttgtagtggtcaatatactggatattttggtaaaccgcattggctgtccccttataccattcgccaccgtctttccctacatacggcggcagcacggctgttccgccgaaatttttgtcaaggtcccatgctttcccgtttccgacatacgagtttaaaagatggggttcatattgcgtcagcacaccgaccgtatcaatgcccgagtgcatgcagttgcttagtgaaaaatcaataattctgtacttgccgccaaaaggcactgccggttttgccagctgggacgtcaaatccccgagccttgttccctgtccccctgctaagagcattgccatccatttcttttctgccattattttttgccacccctttgccgtttttttgattgctttttaaagatcaatgcactgagtgggggaatgctgatttccatactgtatggctggttatgaaaaggctccttatccacttggattgcttctttgttcaacaaaccactgccgccgaaccgttcatcatccgtattgaaaatttcgatatatttcccaaatgaaggcacgccgattcggaatttgtcatatttgatttttgaaaaattacagaggacgatgcaataatctcctttccgcttccctcttctcataaaaattatgatgctctgcctgcgattattcggatcaatccattcaaaaccttcagggttatggtccaagcgccacaagcttcttgtgttttgataaaatgcgttcaaggcttttgtaaactgaaagaaggtacggtgcgtttcaaaatccagcagcatccaatccagctgcgtcaggtctttccattcgtcaaactgtccgaattcgcttcccatgaataataattttttacccggatgtgtcataaaataagcataaagaaggcgtaaatttgcaaatttttgcgggaaatccccgggcattttattgagcagcgatttcttcccgtaaaccagttcatcatgcgaaaaaggcagtacatagttttccgaaaaagcatagtacatggaaaaggtgaggagatcatgggcatcaggccttttttcctccggtgtctgcatataggtgagcacatcatgcacccagcccatattccatttataattaaaaccgagcccgcccgcgtaaaccggcgctgttacgagcggccacgatgttgcttcttctgcaatcattaaggcatgcggaaactttttaaaaacggcttcatttaattttttgataaactcgacagcttccaaattgacatcaccgccatattggtttgtcaatttcttttcgtctcccctgtcatggtttaaataaataagagaagaaactgcatccacccggaagccatcaatatgataaacgtctatccaaaaaatggcgttggaaataagaaaactgaaaatttcaggtttctgaaagtcaaaattgtatgtaccccaaatcggccgttctgccatgtcagggtctgcaggctcgaacagcggtgttccgtcaaagcgcccgagtccgtgggcgtctttgcagaaatggacgggaacccagtctaaaatcaccccgaggccgttctgatggcatttgtcgataaaatacatgaaatcttccggcttcccgtaccggcttgtcggtgcatagaaaccggtaatctgatagccccatgaccggtcaaacggatgctccatcatcggcatgagctcgatatgcgtatagccatgcccggcaacgtatgggaccagttcgtctgccatttcacggtaggtgtaaaaatcgccattggcttttttcttccatgaaccgaaatgcatttcataaatcagcatcggctcgtggtacggatcggattttgctttgtggctcatccattttctatcctgccactgatatgtgccgggatcataaatgacagatgccgttttcggacgcacttccgaatagaacgcatatggatccgctttaaaaaaagtgttgccggaaggccctgtaatttcatatttatacagctcacccggcgcgagatccggaataaacaacacccagatgctcgaatctttgagtcgtttcatttggtgtttgctaccgtcccagccgttaaaatcgccggctacggcaacggcttgcgcattcggcgcccaaactgcaaaccgcacgcccttttttccttcatactccatgacatgtgccccgaacaaagtatagctttcgtaaagggtgccttcgtggaataaataaagctcgaaatcagtgggcaggacttgttgcgaatacttaactgagttttccaatgtcacacctccgctatttcagcatacttttactattcgttatgaattttacgaatcctgcaaaaaaagccgtctaattttgtcgaaatggaaacaatatgattttatttgcaaattcgtcattccgtttttcaatagacgcccatgctgcagtgaacgctgcatcagtggaaaaagaaaatcagccggcgtatattttcagaatagaaaaaagctgttttaaatgcgccgcattggtttgacatgcaatgaatatgcgggtcgcgacttaaaacagcttaaaatcggctgttcaattgtttaacggacgtccattgttttgaagaactggtacgccaaagaaacagaccaggcaagcggtttatttccattcggcacgtacttgccgccgatataaagttccgggatttcccaattttccgtaatgatgcttttggttttttccacatattcatttgccttatcatacatacccagttcatagaaacataaaccaagccatggaaaaccaaagcaccattcggcttcggcgccttcattatagtattggtcgttgacatagcggatcacgccgtatttccgttcaagcgttgtggtgacatcttccagtatttgaagcgccatatctcggctgacaatccggtaagggtaaatgagagacagtaaagcaaggtcggtcggtttgcctgcgctctcccgcggcagcagtttataaagtgtttcttcccctttttcaatcagcccatcctccacatgcacgagcatcctgactgcttttaagccggcaacgcatgccccgacacttgaagcatgcacttccatattctcttcccacatcccgttatcttcggcctgccaatattccagacactcgagatagtcaaccagtttttggataatctccaaatctttctggctgcggatgattttttggccgtggtggacgccttcccctacgccccaaaggaaagcaccgatagcatcgttttgggcatggccccattcttgcgggagttcctcgaggtcagtggaatagcgggcgtggatatattcgtataaataccgtggccttttctttgtatgaatgtcaattttccactcatagcggataaacagatcaagcaatgcctggtatgctttttcataatacggggacggcgtggctaaaaaaggcagaacggtatatacgacatctctgatccaaacataatggtagtcggaagacaaactggcggtataggcaccgtttggcaggcgcatccggtcaatgacctcaacagctttttcgatgttcatcaatcttcacctccaaaaagttgatccataccattagtgttggcaagaggctgatccttttataaccattccaacataactcccctgttttaaagcgctttcaagaagatctttgctttttgcagatgcattcaagccgggaaaagccgtgatttgacaaacggcgttgctgccattgccagccatttcttttcctggacggttgttttttatatattatgtctgcatttgttggatgattatatagaaagcctaatcaagcccgatttttttgcccgtttctgcccgcttgaattccggcatcccggagttttttccgttcctttcccttaaatgcttgttttggtttttgtttttattgtgttatcagcacacagtgtaatttgattatttaggcgcggcatggtttccaatttggcataattgcggctttgatcattttctgttattagtacaatgtgccatacgtacatcttaaccttgatatggatggggaaaatgtgacaatgtatgagtttttagcacattgtgtcttttgatttttttgctctgcctttcagccggattttgcccaaaacacacaggatgtgtaattttgccctttctgcacaagctagaattgatattcggtatgaatatcagcggtatccaaatccttccaagaggtgatcgtatgagctacaaagaccagttggatccgcattccgagttgttccattacaactggacgcggcggaaacatacaaattcccaggtcaatggcgagacggaagttacacaaaacaccatcatcttgaggagcaatgcaaaagcgcatcgctggtgaggatactaaaaaggccgggatgattcccggccttttttggttgtggtaataaacggaaatccgccaaaacgcttgtttttcgtttaaaatcatgctatattggtatagcgatgagctgaattgcataagccggcaaggcaacctttttggaatgcacaatgtggagtgcaagccttagccgccgcaagaaagattggaaaaaagcgccccggaccgggcgcttttttcatgtttatatggccgccacataggtttcttctcgccatgcttcatgcatggactgaacaataaaatcaaccgggcgggctcccgaaatcgcatatttccggttgatgaccataaagggggcaaaatccgcgctcaatagatctgcttctgcctggtcttttttgatatgctccatgtaaacatccgttacaatggctttttcagccgctcttttattcagtccggccatttgggcagcatgtaataaatctcctgtacctggtgaaggctgccgggcatacgtttcaaacagtgccttcgcaatgaacgtctgtttcccgtgttgttttgcaaagtgcagcaatttatggctctcttcaatatgtacttctttttcggggtttttcacgaaactgcgaaattccagttgaatgctttccctgtggccaaattgttccagtgcctcgccaagtcttacaaaggcaagataagaatctgccgatgaaaaatccgaccataattctattttcataactttatagctccttaagcctttcaaaatccttgaatttttttaccagtgatgattaaatcgtgcatgcgtccgtcaagcacagccacttctttcaaatgcccccaagtttcaaacccgaaggatgcaaacaactttaaactggccttgttttcgctgaaaataaagccgagcagtgtttccacccctagcttcgggcaggcttccaacattttcccgagcaggtgcttcccggctccttttcctctccatttttcgctgacataaatactgacctcagcagtaggctggtaagcgggccttccgtaaaaatcgcttaaactgatccaggcagcaatctccccgtctgcttccaacacccaaagcggccggctgtccgggtgatgggctttaaaccatggcaacttttcttctacggtgaccgggactgtgtcagccgttataatcccgtttccgatgcaggcattataaatgtccagaatctcctgcagatcttcttctgtggcatttctgattaggccatgctgtatcatcgctcattttccctcaattgtaaaagtcccctccgtttccggaacggaagctttgtattataaacaacattttataataatttcacgtaattgaacagtttttttatgtcctgcacaccagaccatgctgaaaacacccggtatgaaggcacccggctgccggattccggcggcatttccggtttccgaaagggcaggacagccgccacgggcatcattcaagctttgtccgcacccaaaatatccataaagtttttcaaaatgccggcggttaatccccaaataacataatccccgtagtaataaaaatactcgtccatttgctggctgttccatttatatgatttaccaccctgaattaaatggaaaggaaaatcctggtcaggctctaccttaaattcaatccggtaacattccggcgctgttttggcaaaatgcgaaagcgggactgtaaagacttcttccacctcgcccggattcggatgaaaaggcatatccggcaaaaaacccgcaaacggaaagatcgcgcgccttccatatgatgaaacgacatagtcaagcgggaatacgttgcggatgacagacgcatccatgcacagttcctcggttgtttcccgaatcgcggcttccattgggtttttgtccgtcgtttcaattctgccgcccggaaaacaaatttcccccggctgttttcttaactgccgggaccggacttcaaataaaacatgaaggccatcgcctttttgaacgagcggcaacaggaccgcaaactgggacaaacggtccatcccaaaaacggacggttcccgcctttttaatttttcgataatgaatgcctcgttcaatcgattccccccttttaaacctcgtttccatgttgtgaaaacagttttccctatacctaatatataccacagttttcaagaaaaggatgcatttttctcccctccttttttctcccggagcagaagccataacagcacaggaatcgggcataatgaacaaaaagcatgttttccataaaaaatacaggggaaaatgcatgcaaaaggtttactttttcgcaaacattgaatacaatagtactagataaagttttccctaaggaaacttttttgtttcagggttaaaattaaagaaaggggaaacatctatgagtgaaaaaacgatgagccaaaaaatgccaggccgcacgtcccataatacaacgagcgcacaagctgtactacggggggatgtgaaagggttaaaacggattttgcctttcctaggcccggccttcattgcaggcgttgcttatatcgatcccggtaattttgccaccaatattacggcaggatcgaaatacggctatatgctgctttgggtcattgccttttcaaacttaatggccgttttaatccagtccctttccgcaaagctcggcattgcaaccgggaaaaatttgccggaagtggcacatgaccattttccaaaaccggtgtcgatctttttatggattcaaagtgagttagtcattattgcaacagatttggcagaatttatcggcgcagctttaggcctgtatttaattttcggccttccgcttttgccggccgcattgattacagcagtcggatcgtttgctatcctcgaattgcagcgccgcggctaccgatcgtttgaggcagtgattgccgcccttgtgatgattgtcgtgctcgcttttgctttgcaaacatttctggcaaaaccggaatgggtaaaagtattcggtgggattgtcacgccaaaattcgatggcatccaaagcattgtcctggctgccggcattctcggcgccaccgtcatgccccatgccatctatttgcactcttcattgacgcaaaacagaatcgtcggaaaaaacgagctggaaaaaagaaaaattttcaaatttgaattgatcgacatcatcatcgcaatggtgatcgccggggccatcaatatgagcatgcttgtgattgcgtccagtgtattttataaaaacggccttgtcgtggaagatctggatgtcgcgtttcgtgagttctacacccatatcggaccggcagcggcgatctctttcggccttggccttttgattgcagggctttccagctcctctgtcggcacattatccggtgatgtcgtcatgcaagggtttatcaacaaacggatcaatctttatttgcgccgtgcgatcacaatgatcccgccgcttctcattatcatgatgggcaccaacccgacaagcgcgcttgtaataagccaggtcattctctcattcgggatcatctttgcccttgtcccgctgattctgttcacgagcaacagacagatcatgggtgaactggtgaaccaccggataacgagcatcatctcgtggatcgtggcaggattcgtcgtatgcctgaatctgttccttttgattgatacatttatataaagtgaaacagcccttccatcaagtggaaaggctgttttttatttgccgctgctttttcacggcttaggaaaaaagcagcggcatttaccgtttgtccgccatcgcatccagcatccaaatatctttgtcaaaccggatcagaaaacgggtgagcaggttgacggtggcattgtccttgctttcttccgccaacggaatccccgtttcccggatttcctttgccaactgcgccaaatcctcccttaattgctgcagcagttcgccctcttcattatccgcgctcgcttcaacaagcgtcttctggtcaaggaatttcgacatggtcgcaagcggccgtcccccgattgccaaaattctttcggcaagcacatccatttgttttgaaaatgaccggtacaaatcttcaaaataagcatggagcgtgaaaaagttttttccctgaatataccagtggtaacggtgcagtttgatataaagcactgtaaaatttgaaagttcctggtttaaaaaccggaccagtttttcttcatccaatgcacacttccccccttttacaggccggccattgattggtcctcgttagattttctccgcagggcttttcttatgcatatttaacgccaaatctcaattttgatttttttcacaagcttgcggaccagtaaaaagataccgtaaccgcacaatccacccgttgtattcagcaaaatatcatccacatcaaaacccccgacatggaaatatccttgaatggtttccaccaaagccgatgccaaaaacgacagcaatcccattatccaggcctttctcagccgtctgaaaagaatgggcaagaaaaatccgaacggcataaacatgaaaatatttccaaacagattggaaaaccacacttcaaattgaaaataacggtaataaaggatatacatccggattgttttaaacggaatgatattttggctggcagcattcggcgcatggcggtacgggataaagaacaaaagttccgctaaataagcagcatacacaatgaaaatgaacaaaacggccgcattgatttttttccggttattttttcccatatcatcctccagcggtccgggcaagcccccattatcatcctattcggcgggtgcacacgctatgcgccgcccgtacagcctgatgcgtccgccgctttaaaaaagcaaagagagacctgctctggcagatccctccttcacccggccttttacagccattgtacctgaatttacccgttgtatcaaaacgcaatgtcgcgtttttgaaaataccaaaaggtcaaggtcataaaaacgacataataaacagcaagcgtgattaatgaaaacggcaaggtgacaccgtctgtaagtttatcctggtacgcataaacagacaagtccaaatgcgggaaaatcaggaatttcagccaatggtaccggttcatcagaaatagaataatcccgcccagtgtgtttgtgataaacagggcaaaaatgccgattccgacagctagagcctgactcttgaacaaggtcgaaagcatgaacgcaatcgcgctcaccatgacaaggctcggcaaataaagggcaaatttcaggaaaaattgcggtccgatttctttaattttatattggctgtcacccacagtattttctatcattttcatatggaaactgccggatccctgaaaaagaaggccaatcaaatagccggctataagcagaacggcaagcagcaataccgcataggctgtgacagcaatgtatttggacagcaaaattttccatctcgcatgcgggcggatcatcagttgcttaatcgtcccggatgcaaattccgatgaaacgttggcgctcccaacgatcacactgaacaaggtgacaaatgaaccgagcggaatgaccacattgttcatgaaatgccagtttgaatgggcatccggattgatattgtatttcaaataatcttggtttttttggatggttggcgcaaggtccgcgtattgttcaggatcctttttcattagcgcctcatccgctttgatttctttctcgattttcgtatgccagtttggatcgtctttgccgtacaccttattgtaaaacagtgcagcaattagcacgaacgcgacaatcaggagcatatagacccatgcgcttttccgggcaaatattttcatccattcatttcggattaaagcgatcattgattttcctcccctgttgtatgattcgtgagttcaaggaaacggtcttccagcgttttcttttcaaaatgaatttcatagacgttgcagccgtttcctaccaatgttgcgttgataacggctgcgtctttgtaagctgccgaaaccaaaatacgcgtatcatcgacaatggaaaccggaaaatggagctgtttctccaccgtctgcttcgcgctttcactgtcatccgttgcaaacaagatatcgcggcggtcatcctgttttaccgttgtcgtttctgccatcgtttcaatatggatcagtttccctttttcaataatggcataacggtcgcacatcagttccatttctgaaagcaagtgcgaggaaacgaggacagataccccgcttcctgccagctcccgcaaatagcccctgaattcgcggatgccttgcgggtcaaggccgtttgtcggctcatcaaggatcaataacgaaggctggtgcaaaatcgcctgggcaaccccaagccgctgtcgcattcctaacgaatacgttttgactttttgtttaagggcatcttccagtttgacaagctttgcgacttcccataatctctcttcggaaacgggtttccttgacattctcttatagtggacgagattttgatagccggtcatgtacggataaaattccggattttcaacgatcgcgccgatttcattcaaagcgcctttgaaatcttcatcgaggcttttgccgttaataaagatttctccgcttgtgcgtttcatcaatgaaacaatcatccggataatcgttgttttaccggcgccgttcggaccgagaaggccgaaaacctcgccttttttcacttcaaaactgacctggtctacaattttgcgcgagcggatttgttttgtaatccctttgaccgagagtgccatttcactcataacatccctactttctgctaaacgagtctaatccatatacgaaactggccttaaaaagtttcaaaaaagattcggttaaaaaagcatttgattgtggtatatacatattttaatgaagagccccataaagatattcatagagacgttttgggagtagagggatgaccaatggaaaaactgaaatggaaactggctttattcatcatctgcctggccgtgcttgcaggattgatcttttttcagcgcccggtaagctatcagcgcgtaaagattaccgataaattttacacgcccaaccggaaagaaatgccggttgcaaccggtgtgaaaacaaagcgaaaaataaaagtggcaccaacaacgacaaaaccgtattgcgcgatcgcattcaataacggcaaaacgcttgcgatcgactgcgatacgtatttaaattttaatattggcgaccaagtgtacatcaaataccgtggaaaccggttaaccgatatccgccggaaaggatgaaaaacatcccggttcctttgcgtataaaagaaccgggatgttttttaatcttccccgataatttttacttctgtctcaagatctaccccaaatttttcttttaccgttttttggacaaatttgatcaaattcatataatccgttgccgttccgccgccgacattcaccataaacccggcatgtttggtcgaaacctcgacgccaccgatgcgtttcccctggagcccgctgtcctgaatcagtttccctgcaaaatagccgggcggccttttaaacacgctgccgcacgatggatattcaagtggctgtttcgattccctgagatcagtcaattcatccattttggctttgatctcctgtgcgtcgcccggctccaggctgaacgtcccttcaagcgcaatctccccgttttccgcaattgaacttttcctgtactggaaggacaaatcgcttttttcaagccttttcatctcgcctgttttggtcaggacaagcgcgcttttcagaacatctttgacttccccgccatacgcccccgcattcatatacagcgcaccgccgacagatcccggtatcccgcaggcgaactcaagccctgtcagcttttgctttaaagcatagcgcgatacatcgataatggctgcaccacactgggctgtaatgtcattgcctgtgtgcgatattttcgctaatttggtcagaatcagcacaattcccctgatgccgccgtctttgatgatcagattggagccgttgccgaggatcgtgtacggcacgccgttcagagaggcaaaacggaccgtcttttgcacttcttcatatgtctcaggaaaaatcaaaatatccgcttttccccctgtttttgtaaaagtatatttgcttaacggttcatcttccagaatttcacgcggataaatgagcgaacgcaagtcttgtaaaattgtcttttcagccatgctcttctccttcttttctttgatgcctctttatttccggatagtggaggatcatcgccgccaaacaaaaaagcggatacccgatcagcaccacacccgaaacaaaaccgtttttcgtaaaccattcatgaatgattgtatgtaaaataaacgggaccgtcatgacaaagcatgacattttccataaatgctggtacgccagttttctcttccacagcttcctgagcccgtatccggcacaagcgagcagggaaatgccggccaatacgccacacaggacaacgagcacataagcgaacagaaaataaaaaacaaattggatggcattcagggcatcaagggatccgccggttaaaagtgcagggatatgcagacaggaaaccataagaacaagcagaaccacatacaaaaccgtcctgtccatcggaagcctgttcaaacgaaaagcagctctttttcccggcaataaacagctgtatttgaatgcagtccaaatatccatcctgttatccccctctcccgaatgctccactccacattataatataaaaaacaatttgaaacgagaaccatttacgacagattctttaattccgtttcaattgctgcttttattttttcaaggcaagcctcaggcgttttggcaaaaatcctttttccgttcaccatcgcaaacggactgtaggtgcataacccgcacgccattaagcattcatttgaaatcaccgcaacttcaggataccgggattcaagttctgcttccacatcaattgtgttgatcaggctgccttcacatatttcgactaaaataatgcccaatcccgtttcctccttttgcttaaaagccgtaaaacggcatctttatccattatactgtaagctttaaaaaaatcccaacaggcgcgctttcccggaggtccccgttcatcggaaatcgtatacacggacacttctttcccggaaaatataaatattttccggccaggctgtctttttctttataataacaggagatatttggtacaataatgtaagacttccattttgcttgcagccacctgcgcgcaaaggaaagactttacaatctaatcatgttgaggtgtctacattggaaaaacagcaaatcggcgtcatcggtttggccgtcatggggaaaaaccttgcgtggaatatcgaaagcaaaggttacaccgtttcggtcttcaaccgttcccgttcaaaaaccgagcaaatgttaaaagaatcggaaggaaaaaatattttcggttattttacaatggaagaattcgtccattcgcttgaaaaaccgcgaaaaatcctgctgatggtcaaagcgggcgaagcaacagacgccacgatcgagcagttaaaaccgtttctcgacaaaggcgatatcttgattgacggcggcaacacattctttaaagatacacagcgccgtaacaaggaattaagtgcactcggcatccattttatcggcaccggtgtctcaggcggtgaagaaggcgcgctgaaaggcccttcgatcatgcctggtgggcaaaaagaagcatacgaccttgttgcaccgattttaaaagacattgctgctaaagtaaatggtgacccgtgcacaacctatatcggtccggatggtgccggccattatgtgaaaatggttcataacggcatcgaatacggcgatatggagctcatctcagagtcctacaatctgctcaaaaatatcctcggcctcactgcggacgagctgcacgaagtgtttgccgactggaacaaaggcgagctcgacagttatttaatcgaaattaccgctgatatttttacaaaaaaagacccagaaaccggcaaaccgcttgtcgacgtcattttagatacggccggccaaaaagggacaggcaaatggacaagccagagtgcgcttgatctaggggttccgctgccattgattacggagtccgtattcgcccgctttatctcggccatgaaagaagaacggaaagcggcaagcaaattgctaaaagggcctgaaaaacccgctttttcaggagacaaaaaagcgttcattgaagcggtcagaaaagcattgtacatgagcaagatttgttcttacgcccagggctttgcgcaaatgcgggccgcttcggaagaatataactgggatttgaattacggtgaaattgcgatgattttccgcgggggctgcatcatccgcgcgcaatttttgcaaaaaatcaaagatgcgtacgaccgcgatcgcaatcttaaaaacctgctccttgacccgtatttcaaggaaatcgtggaaagctaccaggatgcgttgcgcgaagtcatcgcgacagctgtccgcttcggcgtacctgtgccggctttgtccgcagcgcttgcctattacgattcgtaccgttcggaagtgctgcctgccaatctcttacaggcccagcgtgactatttcggtgcccatacgtaccagcgcgttgacaaagaaggcatcttccatacggaatggcttgagttataattcagaaaaatcccgccgcacctggcgggatttttttactctccgtacattttgaacacgatttcgcctttgatcacttttcccccgtcttgattggccaccactgcttcatacgtttgccgggcgccttgcgcttctttcagcgttgccgacagtgtcaagcgatcgtctagaaaaaccatgcccgcaaagcgcacgctaaatttttcgatgaatccttcgccaacatacggtgtaaacagctttccgagatttcccattgtccacatcccgtgggcaataatgccgggcagcccggctttttctgctgcttcatcgatcgtatgaatcggattaaagtcgccggaagcaccagcgtacttgattaagtccaaccttgaaaccggcgggagttccatgctttccaggctgtccccgggttttttcgcgcgaaggttcatcctttcatccccttccggaccgtttcagaaagaataatcgtttgggttgcggtcatgacgatttcaccattcttatcttccgccgtgctttttataaacaagaaacccatctgtccgagctttccttttctttcctggtatttttcaatttccctatagcagtgcaatgcttctccgacatagagcggccgttgatattcgaaattttgttccccgtgtatgagcccagctttcggaaggtccaggccttctattatcccgtagtcaaacgtgaccgggaatgtcagcggtgcgatgttggctttaaaccctttttcagccgcaaaggcaggatctgtaaaaacagggtgcgggtcaccgatggcttcggcgaactttctgacagcgcccctttcgatcgtattttggaccggatttgaccgttttccaatcagttcttcaaacatccgcccgcccccttattatgctttcggcccgccggcaacatagagcacctggccgtttacgaacgacgattcttccatcgcaaagaaaaggaccgcgtttgcaatatcttccggctttcctgtccgaccgacaggaatcatcgattgattaaatgcgataaagtcgtcgaatttaacgccgagccgctcagccgtcgcttttgtcatgtcggtttcaataaagccgggcgcaaccgcattggcggtaatgccaaactttccgagttcaaaggccagcgtttttgtaaagccctgaatgcccgcttttgccgccgcgtagtttgcctggccgcggttgccgagcgcggaagtggaagaggtattgatgattcttccgtatttattttcaaccatgttttgctggacagcccttgaaaagaggaacgcccctttcaaatggacattcatgacggtatcccagtcttcatccgtcattttaaacagcagattatcgcggatcacgcctgcattgttgacaagaatatcaatctttccataccgggtgcacacagctgaaaccaccgcttccacctgcgtgcggtttgccacatccgccagctgcccgaatacatcgtaaccgctttctttgaaagcctttacagtttcttccaaagccttttcattgatatcgacgagacagacttttgccccttctttggcaaaggcggctgcaatggctttgccgatccctctgcttgcacccgttacaatcgcaaccctgttttcaaaccttttcaaaaccgctcccccctcgcatgttcgaatttttctgtttgttttaaatatatacagtaaacagtttaaattaaacgcttccttttgtaaatatttgtgcatccctttcaagcactccactgccaaaaattttgtaagcgctttatttttcgtatattataaaaagtagaaatatacataaagaggtggcaagcttggaaaattttattttaaaactgaaagaattgatcggcccggatttggtcagcggaaatgaaacggttcttgagcagcacagcagggacgaatcctatcatacaccccatttgccgcaggctgttgtatttcccgagtcggtggagcaagtaaggaaagtggttgcttttgccaatgaaaaccgcataatgaaaaccgcattccggtgattccttttggcctcggttccagtctcgaaggccatgtcattccttatcagggcgggattacgcttgatatgatgcggatgaacaaagtggtagaagtacttgaccgtgactttattgtccgggtgcagccgggtgtgacgcgcacgcagttaaaccgggagctgaaaaagtatggtttgtttttcccggtcgacccgggggcggatgcaacattgggagggatggccgcgaccaacgccagtggcaccacttctgttaaatacggggtcatgcgcgaccaggtgtatgatttagaagtggtactggcggacggaacggtcattcataccggaagccttgccgcaaaatcatcgtcgggctaccatttaaacgggctcatggtcgggtctgaagggacactgggcgttattaccgaactggctttaaaagtatacggcattccggaagcaatggttgcggcaagggccgttttcgaaacggtcaggcaggcggttgatgctgttgtcgcgatccgccaagccgggatcccgatggaaaggatggaactggttgacaaacggtcgcttcagcaggcaaaccggtttatggggacatcgtatccggaatggcccactttatttttggaatttacagggaacgaatccgggttaaaacaagatgtcaactttgcgaaagacatccttgccgaattccaatgcaaaaatgttatgtttgaaaaagatgaaaaagcgcgccataagctctgggatgcgcggcataaacttgcctacgcttttgtccgcggcacgccgggaaagaaaatgatggtaaccgatgcctgtgtcccccttcatttccttcccgaagccattgaagatacgcgcaaaacgcttgacagaatgggcatggacggggccattgtcggccatgttggcgacggcaactatcatgtcattttaatgatcgatatgggaaacgaaaatgaaattcggcaggcacaggcgttaaatgaacatattgtgtcatttgcgctatcaaagggtggtacctgcacaggtgaacacggcgttgggattggaaaggcaaaatatcagcgtgaagaacacgggcccgcttatgggatgatgaagaaaatcaaggatctgtttgacccgaaccatattttaaaccccggtaaaatctttatttgaggcttttgcccgcatttttttcactttttggggcaaatgtctataaccatgcgccctgatccacatactctaatgttgaacaccgaaaaggagtgggttgagatggaacaaacatatggaaattatccgcaatctcaggggttagggcatttcggcagctatgccgggggaagccagccttattatgatgatgatatggatatgatgcagcattacggtccgatggggcaaatgggccagatgggagcatcagacggtttggcagggcaatatccgatggcagggcaaatgtacccgggacagcatcccgcaacttcgatgtatccgggcatgtacggcatgccggggtacggtcagcatatgggattgccgatgggcccggggtacacaggcgccggttacggccatggacaaatgccgggttatccaggatatgcgggcgctgggatgggcatggccccgggaatgatgcacggttattacccgggcatgacaggcagggattgtcattgctgaccggggcatacccgcgagccaaatccataaggcgtaccaaataaatccgcagtgatacatgtaaacagccggcctgccattgctttagtgcaacggaaggccggctgtttttaacatttcttttaattggccgagcgcttcgtcggtatgtccggcccggatcgttttcaccctttctgtctcctctattccgagcgaatggtcatatcttggatcataataatattcgagcagccattttacggcctcatgatatcgttcagtctgtaaatctttctcgatttcttttgcaaccggcgtgtgaatccgttctttgatgctttgaaaggcacggatgcacgcttctttgttctcccacggccggtaatcatccaaaatattgcggacccgttcctccaccggcaattcaatcataattttcgtgccgcgcgctttgttttccatcaaaaattccggcaccactacttttccgattcttttgctttccgcttccatcagaatatacggcgcatttttcaattgtaaaatgcgctctgccaacaaagcatcgaacgttttctggttatgggagcttaggccgatatccccgaaaatgctgccgcgatgattggccatgccttccaggtcaaggaccggatagccttccgaagcaagcgcccggagcatatacgttttaccggtgcctgtatagccgcccagcacatacgtaaccggatgaaagtccatattttcaagcagacctgtcacccatttccggtaggcgcggtagcctccctggagccggtaggcatggatgtccatcagatccaaaacggttgccgccgttttgctccgcataccgccgcgccagcaaaataccgctttttccccttctatttcacggaaagcctcgataaaaccgggcaactttttcgaaaaaatttcaagtccgcgttctttcgcagcgcggttgccggattgggcataaatcgtccccacttccgcccgttcttcatcattaaataaagggatattcacgctccccggaatcgttgcgttccggtattcggaaggggaacggacatccacccatgtgagctgctttttctccatccgttttcttgcttcttcaatggtaatgtcttgaaacaaatatttcccgcctttctatggttcctgatgggactattgcactttgatacggccgggatgactcgcgacgacttcaccgatcaggctggcttccacccctgattttacaagttcttcgagcagctgttccgcttcatcgccggcaacggacagcaataggccgcctgatgtgaccgcatcacttaaaatccatttatctatttggtccatgccttctgggaagtcgacgacattttcaatatgggcaaaattattctttgtgccgcccggaacagcacctgcttccgccagttcacgcacgcgcggcagcaccggcactttgtcttggtaaatacggagcccatttttgctcccctgcgccatttcggatgcatggcccaaaagcccgaacccggtcacatcggtcgaagcatggatggtgtaatcccgggaaatttcagctgcttttttatttaaggtggccatgacattggtcacgcgtgtgatctcttcttccgttaataaatcccgtttaatggaagtggtcaaaatcccgaccccgatcggtttcgtcaatatcagcttgtcccccggtttggcccctgcattcgtgcggatatttgccgggtggatcgtgccagtcaccgccatcccgaatttaggttcctggtcatcaatcgaatgcccaccggctaaagtgaccccggcttctttgcacttatcaccggcgccttttaaaatatcggcaagaatggctttgtcgagggtatggatcggaaaagcaacaatattcagcgcagttagcggcgtaccgcccatggcataaatatcactaattgcgtttgccgccgccacctggccgaatgcataagggtcattgacaatcggtgtaaaaaagtcgactgtctgcacgattgccaaatcatccgtcagcttgtaaacgccggcatcatcgttcgtatcgagcccgacaagcaaattcggatccgctgccttcggtggcagcgtccgcatcacctgctgcaaatccgccggaccgattttgcatccgcatccgccttttgttgtcagtgaagtcaattttattttttctgattgtgccatattgcatcaacctgacctttcttaaagcatgtctgatccttgtaccattatagaccacttcgcagcaaaatgcattttcttccgctccgtccgcctaatgaggacgctgaaaacggatcccggtggtgaaaccaggcaggtcgggataaacccgcaacccattatggtataataaaggaaacaaatttttgaggtgatcgcgttgaaactggcatttatatccgatattcacggcaatgcgcatgcgctcgaagccgtgctggaagatattgaacaaaagcgggccgataaaatttttgtcctcggcgatctttgctttcgcggcccggaaccacagcgggcatatgagatggtgatggctttaaatacggaagtgattaaaggaaatgctgatgaatgggtgtacaggggtgtcggcatgaacgaagtgccggaaaaggcttatgaaatgatgaaccgggagcgggactggacggtttcccggatggagcagaatgcagtggagtcgttgcaccagctccccgaagaggtaaaatacgaatacggcggcatcaaaattcacggatttcacgccaccccgtacagtttgtttgaaaatgtgccgccggatagtgaaaacagcaagttgaaagagaagttaatgcaggaagacgcggatatttatttatacgcgcacatccacctgccgtttatccgcacgtttgatggcaaaacgtttgtcaatctcggcagtgtcggtctgccgtttgacgggatcgccaaagcctcttatgcgatggtggaaattggcgatcacgattaccaggtttccaatgtccgtgtttcctacgatgtgcaaaagacgatcgggttatttgaagcttccgattatccgaataaagacaagctgatcgacattttaacccgggcaaaaaatgattgaacccacccccggttttaaccgggggtttttttcggcagaagtttttgtgaaatttttcacgaaagagcataaaaaagcgcagcagccccatgccaaaaaagagacagccattggcatcacccgccatttattttttcaccttattatgttatcattaacaattggtataaattttactgtcatagaaatggagatgttgttgctttggctgttgtgaatcatacggcaaaacctgaacagcaatccgagaaaaaggcggcatggcttgccgttttgtttctcgtcattgccgcgttcggccttttttatgtaaaatggtggccgtactatgagaagtctttgcttgccgcccatacgcattccatcgggacatcgattctcggggatccgggcaaatcggcatcattttcatgggatggcaccttccaatatgtgatcgcgtattttcaggctgtttggaaagcggccgtgctcggcattttgctcggttcgctcgtgcaagtgctcctgccttctgcatggctgcttaaagtgctcggcaaaacgtcatttggaagtacggtcattgccggagcgagcgccattcccggcatgatgtgcacatgctgcgcagcaccgattgcagtcgggctgcgcaaaaaacaagtgtccacacctgcggcactcgccttttggattggtaacccgatgctgaatccggcaacgctgattttcatggcttttgtattatcatggaaatttacccttctccgcatcgtcgcagggcttatcatgacgttcggggtcagctggctggcgggccggcttgtgaaaaacgaacaaccggtgaacatccgccagttcgagccagatgccggagaaaacaacgggtcctttttcttaagatggggaaaggccgccggaaatatgatcctgtatcttgttccggcttatttgctttcggttgttgtgttaagtgcggcccgtttctggttgtttccggcattcggccagcatgccggaaacagcattacggcggtgatcatgcttgctcttgccggcatgctgtttgtcattccgacagcagctgaaattccgattgtccagacgatgatggctttcgggctcgggacaggtccggccagcgcactgcttgtgacgcttccggccatcagccttccttccttgatcatggttggccggtcgttttcaaaacaaacccttctgtttgttgcagcctcctgtgttgtggtcgggattgtggcaggattatgtggaatgtttttttaaccaaacgattgcccggagcatatgaataaaacggcgcggctatctggccgcgccgttttgcattcattctctgacttggccgctcccgtaaatccaatattttgtggacgttaaggcatccaaccccatcggaccgcgggcatgcagtttctgggtgctgatgccgatttccgccccgtatccgaactcaaaaccgtctgtaaagcgggtggacgcattatggtacacacaggcggcatccaccatgaacatgaaatgttccgcccgggccccgtcttctgttacaatcgcctctgaatgttttgtgccgtaacggttgatgtgccggatcgcttcatctgtatcttccaccgttttgacgctgattttaagcgcgaggtattcgcaataccagtcctcttccgccgcctcttttgcagccggaaaaatttttcgcaccggctcgtctccgtaaatctccacccctttttcggccagtgcgctaagcagcttttcaccgtgctgggcgagccaatgcgcatggattaaaagcgtttcgatagcattgcagacggatgggcgctgtgtttttgcattgactgcgatccggacggccatttccggctgtgctgtttcgtcaatatataaatggcaattgcccgccccggtttcaatcaccggtacagaagcttcgcggacaacagtatcaatcagctttttcccgcctctcgggatcaagacatcaagataatcacgaaggtggaacatttctgttgccgcctccctgcctgtatcttcgatgagctggacggcatcttcaggaaagcctgtctccgccaatgcgcggtgaatggaagagacgagcgcctgatttgagcagatggaagacgagcttccccttaaaatgaccgcattgcccgttttgatcgcaagcgtggcagcatcgaccgtaacattcgggcgcgcttcgtaaatcatgccgatgacaccgaccggcactttctttttgaggatgagcaatccgttttctttcttgatttcctcgaccgtttccccgaccggatctcttaatttcacaagcagccggaccgcttctgacatatcatggatccgcttctcgttcagcatcatcctgtcgagtatattttccggaaggcccgcccggctcccccgcctgaggtcttttttgttttcgaaaatgatcgtttcccggtcctcaagcaaaacacgggcaatcgccaaaagcgctttgtttttttcttccgttgtttttttggcgagtaccatgctgatattcttcgctttttttcctttttctgcggcttcagacatttaacccagcccctttctgtttaaaggcacccaatgatcgcggtgaatgacttcttctgctgcccgcccgctaggcctcataagcacgcgcaacagctcttctgcaccgtaaagcacttccccttttccaagcagcccttttgcgccgtagacgtccacgacatcgcctttttggaatgtgccggaaatttttttaatgcctgccggaagcaggctactccctttttgcagcaaagcctgttccgcgccgcggtcaatgtatatttttccggcactttccgaaaacagcgcgatccattgtttccggctctttacagccgggcgggcggctccgatatacgtgccgtccccttttccttcgagtatcctgacgagtttatcgcacccttttccttttccaataaacacccggacgccgagggagaccgctgtatttgcggcttttaactttgacaacatgccgcctgttcctgctttcgacccggcgcctccagccattttcatcatctcgggcgtaatatgatcgataaaatcaatgcgctgcgcacaacggtcgtattttggattcgtgctgtacagcccatttacatccgttaaaatgatgagacatccggcgtggacaagcccgctgacaagcgctgacagcatatcattatcgccgaaagtcagttctgagaccgacacggaatcattctcattgataaccgggatgacgccgcggcgcaaaagctctgttatcgttgaataagcgttatggtaccggtcttttgtggaaaaatctttccgggtcaacaaaatttgcgccggtattaagccgtaagcaccgagcgcttccctgtaacgctggatgagcacactctggccgatagcagcagcagcctgcttcccttttaacgtgacgggccgcgccgggtaaccgagcagccggaacccgcacgcgacggcgccggatgaaacgacgaccacctcatgcccggctttgtgcaatgcgacaagggcgccgatatgatcggcaaacttctgttcatcgatttcaccggcgtcatttgttaaagaactgcttccgatttttacgacgactctgtttttctccatggcttttctctccttctaaaaaaggtgaaacaaaaaggcctttccgtccctgtaaaaaggacgaaaaggccttgcttttcgcggtaccaccttttttgggcgacatttgcgccccgctcttttttgataacgcaaaactttgcgcccggttttccgggactcggaaggcaggttcggcaggccgcctgctgctgcacctttcagcctgtgggtgccgctctcttatgcaagggtgatccgcctactattccttcgttcacgttcagtatttttaattatcttacaacagcagtcgcagaaatgcaagcaaaatattttgctatgcataacccaggcagccgggacagaaaataagcttacatgcggatttcccccgaaaatggaaagcaaattactttctatacggtgaaaatttgatatactagtcatgtatgaggtttcatcacctttctttgtgaatcttggtacgtaattatgggaggaaattcacaattaggaggggggaatcagggaacccgtatatttttttgcatctacatatgtgtgggaattccatcagaaaaggagaaataggagatggcagaaacttcagctcaaaaaggcaatcctgaagaaaaaccggaagtaaccccggaaacggcagtcgcacagaaagatttgctggatcaattattggatccggaaatccagcaatctttgacggtgttggttgaaagcctgccgaaaatggccgaactggtcaccatgttaaacaaagcctatgattttgcgcaatccattatgacagataaagtgctggtcaatgattttaaaggcggatttcaaggctttctggatcccgttgccgaaaaagcaaaggggcttgcccaaactgcgattgaagcaaaagaccgtgccgagacgtccacagacacgatcggattgttcggcctgttgagattgctgaaagatccgcaagcccagaagctgttccgtttcctgcagtcttatcttgcagtcgcggaagaacgcagcaaacagcagtaaggtgaatgagaatgaatgaaaacgggggatccatatgagtaaaaaaattgtcattttaggggccggttatggcggcctgttatctgcgttatcagcgcgtgaatatttgtcaaaagacgatgcagcgatcacggtcgtaaaccgtgtgccggaccatcaaattattacggaattgcaccgtctggcagcgggcggcgtttctgaaaaacgggtgtcgcttccgctcagaaaactgtttaagggcaaagatgtcgacgttcaggtggatgaagtcacaaaaatctcgcctgattcgaaagaggtatcgcttggaagtggctttaagctgaattacgatgtgcttgttgtcgcactcggcagcgaaacagctttcttcggcattccgggccttgaagaaaacagctttctgttaaaatcagtggacgatgcgaaacgcattcatgcccatattgagtcctgccttgcgcagtatgtcaaaacgaaaaacaaagcggatgccacatttgttgtcggcggtggcggcctgaccgggattgaactggttggcgagctggcggacaaggtgccggcatggtcgaaaaaatttgcgatcgacccttctgaaatctcgcttatttgtgtcgaagcggcgccttccattttgccgaacttcgcgccaaatctaattgagcgggcaacgaagagcctggaagcgcgtggcgtgcaatttttcacaggcatccctgttacgaaattccaggataatgtcgtggaattaaaagacggccagaaaatcgaaacaaaaacgcttgtctggacgggcggcgtgcaaggaaaccgtgtcgttgcaaattccgggattgaagtaaaccgcgggcgtgcaacggtaaacgcctttttgcaatccacttcccacccggatgtgtttgttgcaggcgacagcgcggttgtcttcccgtcagaaggcgcacgcccttatccgccaacagcacaaatgtcatggcaaatgggcgaattgatcggctataatctttatgcttatttaaaaggcggaaaaatgcagacgttccagccggtcaactccggtacgcttgcaagcctcggcagaaaagatgccattgcgtttatcggggaaaaccaaacgcaattaaaaggcttccctgcttccgctatgaaagaagcaagcaatattcgttacctggcccatattaacgggttattctcacttgtatattaaggaaaaaggcgcatccaaacgcggatgcgccttttttaagcccctttttccccggcaaaacctaagttgcaggccgcgctttttttcgtgcaaattggccgcaaccggctctatacctgcacgaaaaaaagcccggcatcaccgggcagctttacaaaccactttcgcttctttttttctttttgtccatatattccaaatacgcatcatcgtgggtaagccatgcttggaactggcgctttacaaatttttccgcttcttcaaaggcagaaaaagaaggagactgctttaagcctcttgcttcgatcgcccagcctttttgagggtctttataaataaagatcggttccccgctgcggttttggtataaacatcccgcttcctgccctttgatattggactggttatgggcaaaatcgcgtttaagcggttctgttttaaacgtttcgacgacaaacttccggaacgcctcttccgtcagcacagcccccgaggcttttttgtgcccgcccccgtcgtattttttggcaatttccgatacgtcaatatggtcatgaatcgtcctgaaactgatccgtttctttccgaccatgcaaatggcgatataatcgagatgcgggtattcttttgcaacggcattccccaattcggaatgatgcgactcggcatggataacacctgcataatagccgtcaatcacggcctgatagacttcccgcttctttccgttgatatacctttcgatttttttctcttccagatcgaggatcttttcttccaaatcatcaaatgaaaaagtctcactgccgctaagtttatgtagcaaaatctcttcaaactcttcgatcggatacaggtagaaaagatcatttaattttttggcctgcatattcccgttgcgttcccattcccatgtatccatttgccggacaagttcgacaaacgcgtcaatggccccggtcgcgctgatttttccttccgcttgcagataccggtaaaacaatgaagtagcgcttgcctgtttgccgtcttcctccacctggacagaagcccattcatgctcatttaagtgaagcgcgcttttatggtggtcaatcagtttcacttttccgccctgtgcggcataggcatcaagaagctgcgcatttttttcattgaccgataaatcggtaatccataacatgtcttctttatgttcttttttcaaaaaagcttcaacctgggtatttaaaccggacacggaattatactggatttcaatgtctttgccgaatgcaagcctggcaagaatcccgcagccaagcccgtccaggtcattgtgggttaataaacgatacatcaatcttcctccgaaattcaattttctgtatggtctcccatacggctgttttttcacaaaataatgctctttgcctccgcccggttcttggtatataccttgctgccgtccccgatgacaacaagatcgcaaatgccgagaaaaagcccgtgttcaacaacacctgtgtaaccatcaagccaggctccaaacgcgccgatatcaggcgatttgagctttatatccacgatatagtggccgccgtctgttacatacggccggccttctttcatccggaggacagggtttaatccttcccgctcaaacgttttcatcaaatgcttgtatccgaacgggaccacttccaccggcagcggaaaagcgccaagttgttgaaccattttccgggaatccaccacccagatatttctttttgatgcctttgccaccagcttttcaaacaacaacgccccgccgccgcctttaatgccatttaaggaagggtccacttcatcggccccgtcaatggtcacatccatttgtgccgtgtcgttcaagtctgctatcggaatgccgcattcgcgcgcaagtttttctgtcgcacgcgaggtgggcacaccggtgatgtgcaggccgctttgcacccgttcccctaatttttttatcgtgtaataaacagttgagccggtcccaagcccgacaatcattccatcttctacgagttccgctgctttctccccggccatctttttcccgtccatacctctgcacctgcctttactttgattttataacagtcttaaagaattataaaggaaagcgcaaacagccatgaaatgaaaataaaaaaatcgctctgcctttcaaggtttaaacgcaacacgcacacacacgggccatttttggataatataaccggacatgccgggccttatacaagcatacattcacgggcggccgctttttgcgctttttcgggcaatccaacaactttgaagctcgttttccgtcaggctttttgttcaccggatcacaatggcctggctgcccatctgcttccacgctttctcaaatgcttcacggccaagctgcttattttttgttccatacgggtcattcacataaatatggcctggatcgtaccctgtaatgacaacactgtgttcgctgtatgtgatgttaatacttccctggggcgtgtcccatgttttgaaatcagaaaccggctgaaaccgggctgtcgtaatcacccagacagcatgcccttcctcaacattttccaggatttttgaaaaaggctgtcccgttaaatccgccgctcttttgccggcatattttttggccagttcaaaaacagggccgtggtacacgccatacccgggaccatcctccatgttcccgacaaaacctgcgttcggattgccgtgctgcccgtttttataggtaaacggcacatacttgatttcttccgccaattgattcttggtcacatgaaaaccgttatcgacaagcagcatcgcgaggcttgtcacttcacagccgttataaaggcggggcgcatccatttgcctgataatcggcacatcgagcagttttttggcagcagcgttattttgcgcggatttttgggccgattctttatgggtcagatactcatttaaggcgagcaacatgacgatcaatacgattgctgcaaaaatgagcctggatgatttcatctgtgctactcccctttcggttatggcgaaagcattcaccgtctttccgttctttcctgtatgcactttaacccctgccggccggggaagcgcacgggaaactgtctgtcccgcttttaagccggccacgggaagccgccattcctgcagagaaaccagtcttgaattattatatggataaattggaaagaactcaactccgcgtaagagcaatccaaaatgaacatcaaaggactgctgttatgtaatctcacgtgccgatgaaaaatacgtatatttttgtcaggttttcttacacaaagatggtctaaacggcttttttggtatatattaataaaaacaccttacaaagggaggatgcaccggtggcaacgaatgaatcatacttggaaaagaaagtcatctcgatcggaacggtatgtgaattaaccggcttaagtgaaagaagaatccgctactatgaagaaaggaaattgattttcccggaacggacaaacagagggatccggaaatattcatttaccgatgttgaacgcctgatggacatcgccaataaacgtgaagaaggcatccagactgcggaaatccgcaaagaatatatgaaagagaaaaaatacaatgaacgcacgatgcgcgaacaagtcatccgcggccagctgaatgcttatttccgcacaagagaataatgcatcaaacggcagccgggcaggctgccgtttgcgcaagctgtttattcatacacgctccggatatccgtgtttgcaggaagggcgaacggattgtccttgttaatatggtcatagaacataatcccgttcaagtggtccatctcatgctgaaaaacaatcgcgggatagccctttaatttaatgagcacttcattcccgtccaaatcgtatgcctttactttaatccgttcataacgcggcacaaaaccatccactttccggtcaaccgacaggcagccttccccttgcggaaggtagatcatcgatatcgaatggctgaccagttttggattaaaaaccgtgtacgccttttcaccgtcttcatccgcaatataaacggcaaacatccttttattaaggccgatctgatttgcggacaatccaacgcctgcacgcaaattgcatttgccggcaatctccggatcctggctgttttttaaaaactggagcatgcagcgcagttccgctttgtcttcttcagttggcggcatgttcacttcatccagcacttttcttaaaatcggatcgccttccctgacgatatcatccattgtaatcatataatcatcattatatttgctcatagattgaaccctcatctgcctttttcctgaaattctatttacccggcacgggacggccccggaaccggctgccattatacctgtttggacattgttaatcttaccataccgcagcaaaaaaatctaaacagacggaacgccggacacggtttccgccaatgcgaaccccctgcctatcataaaccgggcacaccttttaaagggcggcccggtattttcagctttttgccgttttggcccgagatggagcgtccggcgcacaacagcttgctgtattgcagtggtttttcaatgcacaggaagcgcactgcccttccctgctttttttgataaaacggatcagcgtaaatgccgcataagcaaaaatcacaacaccgagcaaaatactaaataacatcggaacattcccccgttttaaaaagcgatgaaccgcccaatattgtaaatcagaaaagcgatcaagtaagcaatcacaagtgcataagcgatcgaaaaaagcgtcactttccccgaaccggtttctttatggataatggccacggtcgaaaggcatggaatgtataaaagaatgaataccatgaaactataggccgaaagcggtgtaaaagcatgggaaatcacacctgccagagatgcgccgtctggaacaaaatagaggacgttcatcgtcgaaacgaccacttcttttgccataaaaccggtcagaagggcagccgcggcctgccatgttccaaaaccgagcggcttgaagacaggcgcaatccatccgcataggatcgccataaaacttttatcgacaggcacattgaatccgcccggccccgcattcgaaatgagccaaatggctaccgtgccaccgaaaatcaaagtccctgctttccggacgaaacctttccctttatcccatgtgcttctgtacaaactccgcgcattcggcacgcggtacggcggcagttcaatgacaaaaacagaaccttccgtttttaccaccattgaaaatactttggcaagcaaaagcgcaacgacaatgccgagcacatacagcgacaggacaatgagtgcctgatggtggcggaaaaaagccgcgacaaacaaactgtagaccgaaagccgcgcagaacaggacatcaatggggtcaaaagcgtcgttaacagccgctctttcggctgttcaatcgtccttgctgccatgacgccgggcacattgcagccgaagccgataatcagcggaataaacgcttttccgttcaagccgactgattccatcaccctgtccatgaccatcgctacccgtgccatatatccggaatcttcaatcaccgagataaagaaaaacaaaacaaaaatttgcggcacaaaaacgagaacgccgccaactccggccacaatcccgtttaacacaagatcacggataaacggtgttgcccccgcttctttcaaccctgcttcaatccaggcggtcagcgggcctgaaaaaaacttgtcaagccaatccgataaaggggtgccgagccagttgaatgtaatgcaaaataccaaatacatcatcacaagaaagatcggcacgccaaggtatttattcgtgacgacggcatctattttctccgtcagcgttttcttttctgccgccgttttttcaacagcggtttccattagcctgtcaataaattgctgccgctttttaaacatttcctgcttaatggaagtatgcgggttggcggcacggagcctgcgctccacacccgcgcaaaaatcttcgagttccggctttacattcataaacgccggaatttggcgaatcacttcattgccttccaaaaactggagcgccagccatcgtttgttcaatgaccggaaatccggcagccggtccatgagataggtcgccgcatgctccaattcatcgccgtaatcaatacggaaatcgggcacaaccgccttttcttgcatctgctccgatatggccttgcatccttttcctgtccttgcaataatcggcacgactggaatgccgagggcttctgcaagtgaacgatcattcactttcatgccgcgcgattttgcaacatctatcatattcagcccgatcaaaaccggctttccgtactccatcaattggatggtcaaatgcaggttccgtgcaagctgggaagcgtcgacgatattcaaaacggatgtgaagtcttcctcaattaagaatctcgatgccaccgcttcatctttagaaagcgggttcaaggcataaataccgggcaaatcaatcagcaccccggcattttccttcagctggcccacctttttttcaacggtgacacctgtccagtttccaacatattcatatgatccggtaagctcattaaagagtgatgtttttcccgtattggggtttccaaataaagcgacctgcattataaacactccacttggatccgcattgcttcttttttgcggatgccgatgcactgcccgctgacttcaagcatgcaaggcccgccgaaaggcaatccgcatttataacaaacttcccggccttcaagcacacccaaatcaagaaggcgcctttgaatactttgatcaatgcttgataaatctgtaataatccctttgcttccgggtttcagttcggtcaagaccatggtatgcccctcccagagatagagaaatagcgtctgttcattgataatgattatcattctatattcctatcataccgcatttcattgtgagcgtctatcttattttcaggaaacaagggaaactttcacatatttatgtgaaattattcacataatatgcgttgacagccggcttggccgccccaacatgcaaaaagcgggccccttaaaggagtcccgctttttgcggcaaatgcacgccgcttttttcaatgcggcggacagcttccataagcctttcttcatcctgtacaagcgcgattctgacatatccttcgccgtggggaccaaaggcgttgccaggcgtaaccacaacgccggctttgtccatcagttcatatgtaaaagcgagggactttttgccttccgggattttggcccacaaaaacatcgtagcatcagacgggcggatttcccagccgatccgcgataatccggaaacaaacaaatcccttcttttctcatacagtgcagcattgtggcgcgcgaattccttgccgtttgccaaagcagcggcagccgccctttggaccggttcaaaaatgccgtaatccatatgcgatttcatttgggcaaacagccggatcacttcccggttccctgccagaaaaccgatccgtgcccccgccaggttaaagcttttcgataaggaattaaattcaacccccacatcttttgccccgtcaacagacaggaaactgaccggctttttcccgttaaagacgagttcacaataggcaaaatcgtggacgacgacgagatcatattgttttgcaaatcggacggcttcttcaaaaaactttttctcagcaagcaccgggattgggttgcccggaaaattcagcatcatcattttcgctttttttgcgatctcttccgggatttttgacaaatccggcataaatccgttctcttccagaagtggcatcggataaggtacggcttccgccagttttacccctgattcataggctgtataaccgggatccggtacgagaatgatatcgccggggttacaaaagacgagtggaagatggataatgccatcctgggaacccgcaagctgaatgatttcgtgttcaggatccagtttcactccgaactgttcgtaataccgggccgccgcctcgtagaaagctccgatcccggaaattgtatacccgtattggcgcgggtcagctgcatttcgggccatttcttccattacaaaaacaggcggtgcctgatccggactcccgatgcttaagtcaatcatccggttgccttcttctatttttttctttttgtacgctaaaagctcattgaatatcaacgtcggtaactggttcatgcgtcttgcagtgtcaaccaaaagcttttcctcccaatttcccggccctagggctttgtgtgcctattccaggatgcattagcataagattaaaaggtttataatgatttattgtaccacactttccggcatcctgggagctgttatcatacagttctagttggaagcgaaggatccggcctgattaaaagcctgacgattgcgtaagaagcccgtttcttatgcttttgattccgtagccacgtttgcatccgcttgttcaatccggtttgcggagttgtttttccgccatctgaagctgtgccgccacttgtgcatgtcctgttcccccggcgctgttccgcatttttacaacatgaaccggtttcagcacttcaaaaatatcggcctcaaaaagcgggctgaacgactggtattcatccagtgtcaggtcaagcaaatacttgccgtgctgaatgccataaaggacaatctgcccgatcaccgcatgcgcctcacggaacggcagccctttttttgccaaataatcggcaatatcggttgcattcgcgtaatcgttcgagacagcccggaacatcttctcccggttcactttcatcgtttcaatcatcggcgcaagcagcttaagcgccccttgaagcgtatcagccgtatcaaaaatgccttctttatcttcctgcatgtctttattataggcaagcggcaaccctttcaggacggtcaacagcccgatgaggttcccgaacacccttcccgttttcccgcgcaaaagttcggggacatcgggatttttcttttgtggcataatgcttgaccccgtgcaaaaagaatcatccagctcgataaactggaattcctggctcgaccacagcactagttcttccgacaaacgggaaatatgcgtcatcaacatagcggcatttgccaaaaattcaagcacaaagtcgcggtcgctgacagcatccaggctgttcggataaatgcgggaaaatccgagcagttcgcgcgtccgttccctgtcaatcggaaaagtcgtcccggcaagcgccccggcaccgagcggcagccagtccgtccgcttcaggctatctgaaaatctctctttatcacgctccagcatccaaaaataggcgagaagatgatgggcaaacaacaccggctgcgcccgttgcagatgggtgtaaccgggcatcatcgtttctttgttttcttttgcttttgtcacgatggcttcctggacgagcgcaatcaggcggatcatttcttttgtcgttttccggacatacaggtgcatatcggtcgcaacctggtcattccggctccgccctgtatgcagcttcccgccggcagggccgatttcatccatcaacattttttcgatattcatatggatatcttcattctcaactgtaaatgctgcttctccgtttttgattttttcggcaattttccgaagccctgctttgatctgttccacatcgttttcaggcaaaatgccgcattcgccgagcatttggacatgggcaaggctcccttcaatatcttcaaaagcaagcctttggtcatatccgatcgaagctgtataggtttcaacaagctgattcgtttcctttgtaaaacgtccgccccaaagctttgacaatgtcatttcctcctgctgcaatagaattaaaaaatgaaggctgcacggcaaaccgccacagccttccggatattttaccgttttctcccggcccggtaaacaagtgaaaaatacctgaacgggccggttccaaccttgaaatttgtcgtgcttatgatttaacatcaggaacagcggccaaatggcttattgatttagcactttcccgttttcctggatttcggcaaatacttttgtcggcagcccccacagtttgatgaagccgactgcagcattatggtcaaacgaatcgcctttcaaataggtcgccagttcttcattatacaggctgtacggggattttcttgccactaccgtgtgggtgcctttaaacagtttcacgcggaccgtgccggtgaccgttttctgtgtttcctcgacaaacgcatcgagcgcggcctttaacggcgaataccagagcccttcataaatgattttggtcaactgctgttccaccgttgttttaaattgtgtcacttcacgcggcagcgttaaaaattccagttctttatgggcattgatcagcacgactgcagcagggttttcgtatacttcgcgcgatttgatcccgacaaggcggttttcaatatggtcgattctgccgatgccatgtttgccggctgtcagattcagctcttcgatcatttggacgaggcccatcgctttgccgtttaaggcaaccgggacgcctttttcaaacgtaatttcaatatattctggctcatccggcgtcatttcgatcggcgcagtccagtcgaatgccgcttccggcgcttcgttccaaggattttcaaggacgccggcttcgcacgctcttccccatatattggcatcaatcgaaaacggattatctaagtctaccggaatcggaatattgtttttctccgcatatgcaatttcttcatcgcgggtcatgccccattcacggacaggcgcaacgactttcaggttcgggttcagcgcctggacggacacttcaaaacggacctggtcgttcccttttccggtacagccgtgcgccacggcaacggcgccttcctgttccgcgacatctaccaaaagctttgaaataagcgggcggctgatcgcagaagacagcggatattttccttcatagagcgcatttgcctttaatgccggcaatatataatcttttgcaagcatttctttcccgtctatgatcacagctttgattgcaccgacattcagcgctttctggcggatcgcatttaaatctttgccttcgccgacgtcaatgccaagagcaataacatcatagccgtatttttcctgaatccatttaatcgatacggatgtatccaaaccgcctgagtaggccaatacaattttttcctttgccatttctctctccctgcctctttgtataattaatattgaagttgaatttttatacacccattatatcggattcattcaacattttccagtagtttttttaaaatggctttatgggcatggagccggttctccgcctcgtcaaaaaccgcggaatgcgggccgtcaatgaccgcctccgtgacttcttcgccgcggtgggcgggcaggcaatggaggaaaagaaaatctttttttgccagtttgcataatgattcatttacctgataatcttgtaaatcttcgagccgtttcttcgtttcgtcttcctgccccatgctcgcccacacatcggtgatgaccacatcggcattccggatcatttcttccgggttttggcccacttcaatacagaccccttttttggccgcttctttttgagcctcggcaagaatgccggcattcggcaaatagccttccggggcagcgacggacatatgcatgcccacctttgccgccccctcgagcaatgagtggcacatattgttattgccgtccccgaggtagcagattttaagcccggccagttgtcctttatattcctgaatggtcagcaaatcagccaaaacctgggtcggatggtgcagatcggtcagcccgttgattacagggacatctgcgtggcgcgcaaaagactcgatggtttcgtgcgcgaatgtgcggatcatcaggcagtcgacataacgcgacaacacttttgccgtgtcatggatcgtctcgccgcgcccgagctgaatatcccttgaactgaggaaaagagcgtggccgccgagctggagcatgccggcttcaaaagaaacccgggtgcgcgtggatgatttttcaaaaatcattccgagcactttcccttttaagtacggggtctccttcccttctttatgcgctttttttaaagcggccgcttcctgaagcagatcgttcaactcctcttcctgcagcgcgccgattgttaaaaaatctttctttttcgtacgggccaatgtcgccatctgtatcttcctttctgctaaacttctgcttttatacggttaaaatcgtgaagcggggccacttttggcgttgtccctgtggcatagcgggtaatggcttccaatgtatccagacaggtaaacagcggaatatggaaacgcatcgctgcttcacgcagcttgctgccgccccttctttggtcccgcccttttgtcgggatgaccaccgcagcggttacgggttgctgttcgaaaaaggcgggggcatcctcaaggcctactgtttccgccgccacgccgtttttcgccaggaaccgggccgtatgttccgttgcggcaatccggtagcctctgtccgccagtgttttcaataccgggagcgcggctgctttttcgcggtccgtcaccgagcaaaatacaaattgttcttcaagcggcggctcaaacaccgggtcatggacggacagaagcgttttttcgagtgcttccccgaatgtccgggcaaggccgagcacctcgcctgttgatttcatttcaggccctaaaacaggatcgacatctttcagttttgtataggaaaataccggtgccttcacggcgacaagttccggcggtgcaggaagccctttttccgcaagcggttttccgagttgtacggcaatggcgagatcaatcatcggaatgccggtgactttgcttaaaattgggacggttcttgaagcacgcggattcacttccagcacataaacggtcccttcataaattaaaaactggatattggcaatgcctttgattttgccctttaaacagattttttcggcataccggataagcgtttcctgcacagacgggcttaaatgctggtgcggataaacggccatgctgtcgccggagtggacgcccgctttttcaatatgttcaaaaatgcccgggatgagcaccttctccccgtcacaaatgcagtcgagttcgcattccgtacccggcaaatactggtcaatcataagcggccagcttttttcgcttgcgtacttcaacgcatccgcataagcgttgagttcgtcttcgtggtaaaaaatgaacattgactgtccgccaataacataggacgggcggacaagcaccggaaacgacaggtcttttgccccccgtttcagttcttctgcatcataggcggtatgccctttaatatgcggaatgccaagctcatccagcagcttgtaaaaaaggttgcgatcctcaagctggtcgatttgttccacgttcgttccaaacagtttcacgccttcagcttcaaggctcgatgcgacattgatcgcggtctggccgccgaattgcgtgaagacgcctgccacctgctctttttcaataatatgcagcaaatcttccgggcgcagcgggtcaaaatacaatttatccgccattgaaaaatcggtgctgaccgtttccggattgttgtttacaacaatcgtttcatagccaagttgtttgagcgccataacggcatggaccgagcagtaatcaaattcaattccctgcccaatgcggatcggtccggaaccgatgatcagcactttcgggcggtttgatacttccacttcatcccggccgccccaggtggaatagtagtacggcgtttgcgcctcaaactcggcggcacaggtgtccacaagtttataaaccggcataagcccgagctgttttcttttttcgcgcaccgctttttcgctgcatccgcataatgccgaaagacactcatcactgatgttcatttttttggctgcgcgcagcaaagcagccggcatcgtatcgatcgtatattgcttgcatgtttcttccatatccacgatattttttattttttcaagaaaccagcggtcgatttccgtgtatttttcaatgtcatccagcgccatgcctttacgcatcgcttccgccaccgcaaacaggcggatatcggtcgcttccgttaaaagtgggaccaaatcatccggctgtttttcagcaagcgccggatagaacagacctgaaagcccgagttcaagcgaacggattcctttgttaagcgctccttcaaatgtgcggtcgatcgccattgcttcgccggtcgccttcatttgcgtgccaagtttccggtccgcttccgtaaatttgtcgaacggaaagcgcggaattttcacgacaacataatcaagggccggttcgaaggaagcaaacgtgttgccggttaccgggtttaaaatttcatccagatgatagccgattgcgcatttcgtggcaatgcgggcgatcgggtaaccggttgctttcgaagccaaggcggatgaccggctgacgcgcggattgacttcaataatattgtactggtcggagtggggatcgagcgcaaattggatgttgcacccgccgatcaccccgagcgcgcgaatcacttttaaagaagcgtcccggagcagctggtactgcacatccgataaagtctgcgatggcgcgaccacaatcgagtcgcccgtatgcactccgaccggatcgatattttccatattgcagacaatgatgcacgtgtcgtttgcatcgcgcacgacttcgtattcaatttctttccagcctttgatgcttttttcaagcagcacctggtggatcgggctcaggtcaaggccgcgctggagcacttcccgaagttcttcatcattggctgcaaatcccccgccggagccgccaagcgtataagcggggcggataatgacggggtagccgatttttttcgcaaatgccagcccgtcttccatattttccacaatttttgacggcgggatcggttccccgatatcaagcatcaactggcggaacttttcgcggtcttcccccttctggatcgaatccaccggtgtcccgagcaattgtaccccatacttatcgagaatccccgcttcatagagctggacggtgagattcaggccggtttgcccgcccaatgtcccgataatgccgtccggacgctctttttgtaaaatctgttctatcgactccaccgtcagcgggtcaaaataaatccggtcggccatttcttcatcagtcatgatcgttgccggattgctgttgacaagcacgacttcaattccttcttctttcagagcgaggcagctctgcgtacccgcataatcaaattcggcggcctggccgataacaatcgggccggagccgatcacaagcacttttttgatcgatttattgaatggcataagacaaaactcccgctctttgttgtactcgttgtaaaaagtggtcaaaaatgtattcggaatcacgcggccccggatgtgcttccgggtggaactggacggaatagaccggcaagtccggatggatgcagccttcaaccgtgccgtcattcacattcttaaaggaaagctcgagttccgatccggcaagtgatgcttcatcgacaacatagccatggttttgggctgtcatcaacacttttccagtctttaaatctttaaccggatggttgccgcccctgtggccgaacggcagctttttcgtctttgccccgtaagcgagtgccaatagctggtggccgaggcaaatgccaagcaccggataagcggcgcttacttttttgatttccggcagccactcggctagtttagcaggatccccagggccgtttgaaatgacaatgccgtcaagtgcaagttccgccatttgttttgccgtaaaatcaaagggcacgacggtcactttgcagttgcggtcaagcaagtattgcaaaatggattttttgtagccgaaatccatcaaagcaatgtgcaaagggccatctccatacgtttccggttgttttatggccacttcggctacgaaaaattcatcgccgccgcatggcactttttgatcgcgggacgttgaaacaaggccgcgcacagtgccgcgttttctgatcgtttttacaagcgcgcgcgtgtccactcctgcaaggcaagggacacccgacttttccaaaaaggatagggccgtcttttccactttataaaaactcgggcttgcgcatatttcaccggtcacaaccgcgcgcgccgagatgcttttgctttcgtgatcatcgccgtttacgccgtaattgccgattaaagggtaacaaaacaccagaatctgcccggtgtacgacgggtcggtgagcatttcctggtaccccgtcatgccggtgttaaataccacttctcccgttgtttcagcggggtttcccgcaaaaaagccttcaaaaatttctcccgtttcaagaataagatatccgcttgtcacgatgtctgtcctcccttgtctctttgccggttaaagattgttttggcttgccttagtaaaaacagttttcattttttctgcaaaaagcgccgtttccttttccgtaataacaagcggcggcaacagacggacaacatgcgggcctgctgttaatacaagcaaatgctcagccaatgccgcccgggtgatttttacagcttccatttccgtttcaaggccggccatcagccctttcccgcggatttctttaataaaagaaaattgcgtcttcaagtcttccaattttgtccaaaaatcgatgctttgtttttggacatgttcgatgatattttcttccgcaaacgtttcaagcgttgccagaccggctgtcgcagatagcgggttgccgccaaaagtgctgccgtgcgtaccgggcgtaaagctttgcgcgattttttctttcgcgagcatggcgccaatcggaatgccggaccccagcccttttgcaagcgtcatgatatccggttcgaagccgtactgttcataggcaaacagtgtaccggtacggcccatgcccgtctgcacttcatctacaatgattaaacaatcgttctttctgcacgtgcggacaagggcatccacccaatcctgttccgcagggatgacgccgccttccccctgaatcagttcaaacatgacggcaatgggcttaagcttttcgagatcgcggagtgccgtgatgtcgttaaacggcaaataggtgaatcccggcacaagcggttcaaagccatgctggattttttcctgtgccgttgccgacaatgtcccgagtgtccggccgtggaacgaagccttgaaggtgacgatgggccccgattttccgcgtttttttgcatcaaggcgggccagtttgatcgccgcttcattggcttccgcgccgctgtttgcgaaaaacacccggtcaaatacgctttgtgctgctagtttttcagccagctcttcctgcggcccgatttcaaacagattggaagtatgccagatttggtccagctggccggtcaccttggtttttaccttttcggggacatggccgagattgcaaacggcaatgcctgaagtaaaatccaaatatttttctccattttcatcccatacataactgccttttccttttacaaactttaccggcgtccggctgtacgtttgcataagtgcttgcttttttaccgtttgcgtcatcttatccatcgatcaaaaccccgttccctgtaaatttcgtcccggtttttccgccgcctgccaaaaacaggaggctgtcttcttctgtcccgtccacaatcaccacttcttttacgccggaccggatgcattccgctgctgcccggactttcggaatcatgccaccggtaatgacttgtttttggatgagcccgtcaacctgtccgggggtaagataagggagcactttcccttccatcatgaccccggggacatccgtcaccatccaaacacgcgcgttcattttccgggcaaccgcggctgctgccaaatcagcattgacattcaggcgctggccgtttttatccgtcgcaaccggggaaatgaccgggataaactgctgccgcaataaagcaagcagcacctgttcatttacggattcgatttccccgacatatccgagattgggtgtctcaatcttcctagctgttaaaagccgtgagtcggttccgctgatgccgaccgctttggctcccgcctgcgagagccggcgcgtaatccatttgttgatggaaccggaaagcaccatctcaacgacgtttaacaccggctcggtcgtaacgcgtaacccgtttttaaattgcgttttgatctgcattttttccaacatggccgagattgccggccccccgccgtggacgatgacaggttcaagcccgaatcgcgctttgatttgcaccagattttcaaaaaatgcatccggcagctggtggagaatgctgccgccgcacttgatgacaacgtatgccaatttggccaaccccttataaatagttatggcattgtataattatgcaacgatgcgtgcaccaacattatgaacgataagtggcattgattttcacataatcataggtcaggtcgcatccccatgcagtaccctggcaagttccggcaccaaggtcgatggcgatacagattttgtcattttcctttaaataggcatgtgcctcgtcttcggaataggaagccggcatgcctttttccactacgggaatcccgccgatgcggatagaaagcgcttgttcatccacttggacgccgctgtatccgatcgcattgataatccttccccagttcgcatcggcgccaaagacagcagcttttaccaaatttgagccgataacggtttttgcgaccgtttgtgcctctttttccgtttcagccccggttacacagacttcaaccagtttcgtcgcgccttccccgtctcttgcaatttgtttggcaagttcccgggcaatataggcaaagctttctgcgaatttcttccaatccgggtgtgcataggaaagcgtatcgtttccggccagcccgtttgccattacaacgaccatgtcatttgtgcttgtgtcgccgtccaccgtaatcatattgaacgtttcatcgaccgtttgtttcagcaggttttgcaatgcagcggcctcaactttggcgtctgtcgtgataaaagcgagcatcgttgccatgttcggatggatcatccccgatcctttggcgcagccagcaaccgtgaccgttttcccatcaatttcaagcgttacgcaggcgcgtttttgaaaggtgtccgtcgtaagtatcgctttttcaaaaaggtccggatgggatgtaccctctttctcgatacggcgaatgccggtttcaattttttcaaccggtaaaagctcgccaatgacacctgttgaggcaacgccgatcaggctttcgtttacgccgatttgagcggcgaaccattcccgcatcaggcgggcgtggcggaggccttcattgcctgtaaaggagttcgcgtttcccgaattcacaatgatgccggacagcttcccactttccataatgctttcttttgtaatctggatgggtgcagcttgaaactgattcgtcgtgtagaccgcagccgcttgtgccgggacagcggagtaaagccacccaagatccggacgttttcttttaatgccgcaatggagcccaccggcaaaaaatcctgccgggctcgagatgtttccgtctgttttcgtaaaaaatgcagtactttctttttcatataattgattcattgccatcctccatatataaacggtatgtttaagattgccttatggataaaccggaacatggtcgagccctgtatcttcttccagcccgaaaagcagattcatattttggattgcctgcccgcttgcaccttttacaagattgtcaatggcagaaatgaccacgagcctccccgtccgttcatccacatggacgcctatatcacagtaatttgaggcgtatacttcctttgtagatggaaaagaaccagccggcctgatccggataaatttccggcctttatacactttcctataatattggcggacatcttcggtggtgactttttttgctaaaggcgcgtatatcgtgcaaagaatccccctcgtcatcggaataagatggggcgtaaatgaaattttcgcttcttttccggcaaacgccttgatgaaccgctcgatttccggtgtatgctggtggcttccgactttgtacgcaccggtattttcatttacttcagtaaacaagttgcctagagaaggggttcttcccgcaccggaaacaccggttttaccatcaatcacaataaaggaagtatcgatgaaccccccttgaacagacgggagaagtcctaaaagcgctgcggtcgggaagcagccgggattggcgatcagttgagcctcttttatcctgtccgcattcatttctgaaaggccgtagatagctttatccagctctttttgcggggcgggttcgcgtttataccattgcctgtacgcttccccatccagcctgaaatccccggacaggtcgatacactttaaacctttatcaacaaaccgtggtacccagtttttggctaccccagacggcgttgcgaaaaacaatagttccaccctgcctgcgatttcatccggaaccatgtcttccaatccggcttctatgatttgctggaaatgcgggtaatgtgaggtcagcatcgtgccttttgtacggtgcgatatcaacatttccagttgtgcgctgggatggcgggcaagaagtctgacaagttccgcaccgctgtatccgtttgccccgacaatccctattttcaacattttcatctccctattgttatgtatgtgcattattataattcattatgtatgattatacaaggttaaaaatataaaaaaatagaaacttttcgctttcaagcataacaaaaaagatcaaggcctgcatccggcagggcttgatctttttcgtctgcaaggaaaattagtcgtgtgccaatacgacgatttttccgtttgccgccgcaccgacataccgggtggcaatttcaagcggaattccgagctcaaggaccttttccaatattttttccgggtatgtttttcttttgaccagtgctttcagttcattcatgagatccacatccgtatgaaggcatattccgtttacaccttttccggcttcgcggccgacttcacggatggccgcagcattgttggcgatgacagtaatgcgcccattttctctatgatgatgtaaaatggcttccgctgcttccccgggtccggcaaaaattccaattaactgcatatgcgtgtccccatattaatcaccaaaagaaatgacgagtttttccagttccgccgcgctgggttccgtcatcgtaaagccgagtcttttcatttcttcagctactgccgctgcatggctttgatccgtaacaataaaggtgcggtcgcgctgaatggtgtctttcactttcgccaaaaaggaaaacaaagcagcggttttcggttcttgaatttcacgcataaaatgggaagatttctcggttaccggcaaaatccaaatctcacatgcatatggcatttttaaaatttcatagaaagcatctgttttttcgagcggcgtacgcagcgtataatcgaaaaactcatacactttccggctggaaaaagggaagtttgcaaacgggcgagaatcttccttgtcgaacacgtgaatgtccactttcgatttatttttttcaaaataattgtcttctgtttttgcaacgatattttgcatcgttatgttcccccttgtatgtaaatcagatttctttttatattgcctttttgccccgttcttaaacaccggcgttcgtttttttcgaatgtttaacccgtttttcctagggtagacaggaattgaagatcaaaaccggaacaggagtggagcagatgtttttacacaaaaaagagttgcagtttgaagcaaaacctgaaaggccggatccggttttcgccaataaagtgcaggaagtgctcggcgggcaatacggggaaatctctgtgatgatgcagtatcttctccaaggatggaactgccgggcagatgaaaaataccgggatatgctgcttgatatcgggacagaagaaatcggccatgtggaaatgctcgccacattaatcgcccgcctgctcgataaggcaccggtcaaaatgcaggaagaagcggttgcgaaagaccctgccattgcagctgtcatgggcgggatgaatccgcaacacgccattgtcggcgggctcggcgcgttgccggtcaacagtgcgggtgttccgtggagcggcagttatatcgtatcaagcgggaatttaatcgctgacttccgcgccaatctcaacgctgaatcgcaggggcgacttcaagtcgtccgcttatatgaaatgacggacgatccgggcgtgaaaaaaacactatcgtttttgatcgcgcgggacacgatgcatcagaaccagtggctggccgccctgcgtgaactggaagaacaggaaggtgttgtcgtgccgagcacattccctcctgaacaggagcctgaagaatttacccatctctttatcaatcattcggaaggcaaagaaagtgccaagggaagatgggcgagcggcgaaagcattgatggaaaaggtgaatttaaatttgtcgaaccttttgcatcccatgaccgtgtcggacaacaaccggcaccgccctatgtgcacggaacactgccaatcgttaaataaagcaaaaaccgaaagaagactttccttcttccggtttttttgccatttcttaatatgcacccgccatcaccggttggcggtaggcagatagcgactcatccatgattttttgaaaaagcggctcaagatgtgcggggatcagctggccggcaaaatcccacgcattttgctcaatcgtaagtgccagtgcttgcttttccggtaaatgcccggactcttcaaaggcggcggacaatagaggcagattttcatccatcgcatggccgatttcatgtgcaagcacaatcgtggcgtaaggcaaaaaccattcgcagcttccaaacaatagctcgcactgccgccggattgtctctatatacagcgtaatcgtatcggtgtgcggatggtatttgccgccaacaaggcgcccgccggggaactgtttctttattttcaaatgggcggtgcacccggcgttttttagtaattctgttgccatttctctgatttgcaaaattcccctgtctcctttatccatattggcattgctcttatcatatattatgaaagatcgcgattgcaatatgtatctattttttatccgaagcggccggattaaaaggatattttttttcctagcaaagggacgtgtgaacctgattcccaaggcaaaaaaaacaggccataaaggcctgttttttataatttcgaaacgtttgcagcttgtggtccgcggttgccttcttcaatatcaaaagatacggattggccttcttccaaagttttaaaaccttcgccctgaatcgctgagaagtgaacaaatacatcgctgccgccttcacgttcgataaatccgtagcctttttccgaattaaaccattttactttaccttgttccattttgtttcctcctaatgtgtttgaacacaaaattactatccttgctcaagtgatttcagggggtcagttttaaaactttttccttccttaccataccgaacaaaaataattctttattataatagcagattataaatgtggtgtcaagacgaattgattatttttttctttatttttttctccactaatgccgtgattttttcggatgaaaacctttcatggctgccgaatccatccgcctggaaaaatgctgctgcaaaaatgggaaaaagatgcctgcacgcaggcatctttttcggtaaagcgttttatttttcttccctgtacccgtggcccggaaaattcccgtatccgctgtggccgtaatgcccggaatggtaatgatgatggtggccgtgcgggtaaccataaccatgtgagtggccgtacgagtggccgtacgaatgcccgtacggataaccgccgtaaccgccgtatcctccataatggtggtggtgcccatacggcatataatggcccggatagccgccataatactgcctggattctgccaaatttgtcactcctttatccattgctgcttttacaatatggcagttggaagcgcatcgtttgtgcatccgcctgcaagcgggaaaacaggcgccaatttaaacggccggatgtgcgtctgcattgtaaaccccttgctaggccagcctgcttccggacataccgtacgggcaataagtatgcggttatgatgagaacgatatgcaagcttattcagcgacaatggtttcgcaaaaatgcaggcgttggcctaccgtatccagtgtgaccgggatgccgagcggaagcgccagattcggggtaccgtgcccggactgtatgccggcaagcaccggcttaccgctcccgtaaaaaaactttttcaggacatcctgtgccgtaaacccatccgcgtatgcttccggctcacagtccgtccattgcccgagcacaaacccggaggcgtcatccagttttccggaaagctgaagctgggtcagcatccggtcgatcgcatatggctcttcatgcacttcttcaagaaaaagaatttttccgcttgtatcgatttcaaacggcgttcccatcagtgcgcagattaatgacagattcccgcctgtaagcggcgctgtcatgaccccttcaccccacgcttcccccgtgtaactgccggtaggaacaccggttgacgccagcttgagcaatgattgtaccgaaagcgcatcgtctgtgataaattcgacagccgccatcgggccatggatcgtggcgaggccgcatttttgctggaaaacgatgtgtagtgctgtaatatcgctgtaaccgataaataatttcggattctcccggatccattcaacgtcgagatacggtaaaatttgcggtgtcccgtacccgccgcgcaaacaaagaattgcccgcacgtcatcgtctgcaaacatcgcatgcagatcggctgcccgttcaagcggcgtaccggccatatacccaccgtatactttctccgcattttctcccacttttacccggaaaccgagccgccgcaatttcgcaacagcagtttgaagcctttcgattgagaccgggcttgcaggcgcgaccagcccgatcgtatctcccgcctgtaatcgtttcccttttctcatccttctcccccctggttgatgaattgcagtacaatttgctcttccgcttgatgtactgcttcttcatccagtacattattgatcaaaatggaaaaaatcagcttttccccggatgttgcctgcatatagccggaaagtgtgctgacgcctgtaatcgacccagttttggcaaacacctgtcctcgagcagccgtccccttaaaccggtttctgagggttccgccttccaacctgttttcagcccccgcaacaggcagcgcatcgaaaaagcacggaaaccagtctttttcctgtatccggtataaaagcgccgtcaaatcatttgcccggaccaaatcggcgtgagatatgcccgaaccatcacggagcatcatctggtcagggtccatgccaaagttacctgcaacgctgcgaatgacttcaagccctttttcccagcttccttcccctttttccgttttccccatttcttttacaagcatttcggcgatggtattattgctgaattttaaaaacggcaccatgatgcttgataaaggcggcgattgcgaaaagagaaccggaactgctgcatccttcaccctgcccgttttgattgtgccttgaacggtgatcccgttttcctctaacgtttttttgaaaacagacagcacccatttcgccgggtcccagaccgctttccattgccggactgcggcggaatcggctgtaatcgtcccgcttgccgtaaacgtattcccgccatgtgcccggctgatgacgatatcgtcctcctgctgctcaccgtctcgcacggttcggacatggttgaccagtttaaccatcccgctttccggaaccattttgattcgcgctttcatgccgggtttttttgccggaacaacttcaaaaatggccgtccctgcatcataatcccggttaggcgataaagttaaagccgaaatttgtgcgccgtaatattcctgttcatcgctccatggcaagtcaagtgaataccgggtatcatcatagcgcgaatcatccccgaccaggtccccctgaatacgccggattccctgcttctttaattcagccgcccagtccgctaaatcggatttcaataaagcaggatctcctcccccttgtatgtatatatcaccgtaaagcgtaccgttttggatcgcgcctgtccggtacacgcccgttttaaaacgggtatttttcccgagcgtttcaagcgcggcggctgcggtcagcagtttcatattggatgcagggcgcagcagcgtattgccattttgttcgtagagcagtttcccgctatcagccgaacggacgctgatcgcaacgatcccgccttttaaaggggcggcctcaagaataccggcaatctttgcgtctgtttcttttttcccgcagccttccctgtcccctgctgcataaggcccagttccctgaataaatagaaatgccatcgtccatatcacgacccatcttttatgcaatccgtttccctccgtatgaaattctgccttgctttatcatattccttctttattttaatctttccgtaaacgctgttttggctgctatcttcttttttccaatgattcatttcgcgtttttaaatatttttttccaaattagtagaacaagcatgcctgtatagtataaaatgcttgtgggggtgtaatcatgtaccggtttggctattatgttgttgccggcattttttggctgcttggcggcaaaatcaaaaaagaaaacaaagagaaaatccctgcggctccgtttgtggtcgtttgtacccaccaaacatggctggatattatttacctggcgattgccatctggcctgtccaaattcattatatggcgaaacaggaacttttctctaaaaaatggtcaaaatggctattcacgaagttgcacgcttttcccgtcaatcgtgaaaatccgggcccgagctcgattaaaattccaatgaaacttttaaaagaagggaaggtcgtcggcattttcccttccggaacacgcaaaagcgaacatgtttctttaaaacgcggtgccgtgacgattgctttaaaagcaaatgtgccgcttgtcccggccatttacgaagggccgaaaacgttcaaagaagtcctcgcgagaaagccgaaacgcgtgcgctttggcgacccgatcaggctggcagacggaaaaaaaggaacaaaagaagaaattgaaaaaacgattgttctgctgcaagacacttttgaagcgctgaaaaaacagtaaaaatgctttctgcttgcccgaagcagatgaaaaagcacaaaagaaatcaaaaaaacggcgaggcaccgcattcaaagtgcctcaccgtttttttcatggacaaataaagataaaacatccctttttctctgtcccttgcctgccggcgaaagggtttttccttttttaattgaaaaaacagtccatcttttcttataataaaagcgagtacttgccaaggaggagagcgtcatgctgagtggatggttttctgcctttattttaatatggatcctctgtctcgtttttctcttttcagttggcggctattttatgttccggaaatttttgaaaaggcttccgaaagaagaccgaaaatcaatacttgaccggcaggaggagacaatccttaaaacgcggcacctctggacgccggagtacagggaactgcttgaagaactggtaagccctgtcccggaattgttccgcgatgtggccaggaaaaaaatcgcagcaaaaatcggggatgtggcgctttccaaaaatgcaaaaaaaatgacactggacaatgtcattcagggctatattctcgccacgccaaaacgcgaccataaattcctccgaaaaaaattaaagcagctggacatcgacgacagccgatatgagcatttgtttgcgcaggaaaaaacaaaatcggcccagtaaatgaaaaaacatcattcggcaaaagcgaatgatgttttttcaagcacggaccccttcatccagttcctgcataagccgcctgtactgaatatacatggcgacgcgccacggcagaatcatgccgaatgcgagcagaaaaaacataccgctcagctgcccgatttgaatcgaagaactaagcaccaccttcatcagcaaccggatgagaagaagcccgatcagaataaacggaaaagctttcgatcgttttaaatatacgtttccgtcacggacttcgaaacgggaagttttaattaaaaatatggaaaagaacattccgaccacaaatgcttccaatacttcggcaggtgtcacacgaaaatacgggacgacaaacatcaatgccccggtactcataaagaccggcggcaacaatattttttttgtggaaacgggcttgttctgcccttttaaacggacaaaaatgaccaaagaccccatcaaaatcgcaacaatgaacgagatgataatgccttccatgtctcaaccctctttaggaacagatttttaacaaaagaaatgtagatacgataaatatatgtttcctatggtaatattcaaccataaaagcggggttgatgtccagtcggaatgcctgcctccctttttttacggcgcctgtcagttcaaaacgcgttcaaccgcttctaaaacacgcgtttcatcaaaaggcttgacgataaaatcctttgcgccggattcaattgcttcgacgaccagtttttgctggccaagcgcggagcaaataataatttttgcgtccgggaattcgcgcacgatcttttttaccgcttcaatgccggtcatctccggcatagtaatgtccatcgtcacaacatccggcctgacttcacggtataattcaatcgcccgctgcccgttctccgcttcgcctacaacggtatggccgccgtttcccagcattttcgccaaagtcatcctcataaattttgcatcatccacaattaacacatttgccatcgatcgaatttctcctcctcattgatccgttaaaatgcaacccggattaaaatccctggaatcccccgaacagtgcactcatataaccggaaatgacaggcatccagtcaaaaaagagcaggattccggcgactatcatcacaacaccgctccattttaaaagttttacgctgtatttttgcatccaccccaaccgtccgataaaaaaagcaaggacaaaaaaaggtatggaaaagccaagtacatatgcagccatatagaccgacgcagaagccggatgggccactgccattgccaataccgaggcaagaatcggcccggtgcagggcgtccagccggcagcaaacactagcccgacgagaaaagaacccaaaaatcccgccggctgcttttttatatcgattcggtacaccttcataaagatccccggatgaaaaattcccgctgcaagcagcccaaaaaaaatgagcgcgactgcaccgagctgccggatgacatcctggtaacggataaaaaaactcccgatccaggaagcaccaaaccccaatgcaataaaaacagtggaaaatcccgcgagaaaccaaacggtatgcaggatacttttccactcccgcatgccgcccccgctttttaaccggctgacagaagcgcctgttatataagaaacaaaagcaggataaagcggcaggcagcaaggagatataaagctcatgaaacctgccccgaaagacagccatacagttacatcagccatcggttcactccccatcccggctcattttcattttaacataaactgattgaaagagaaaaaacatcgtgaaaagcataaaaatggaacatgaaatcaaaaaccaccttttctgtgcagaaaattggcagaaaaagtggtttacagaatcgtgagaagcttaacaatggtgatggatataccacaaaagccggtcgcccagcttaagatttcatttgtttgttcatggcattcatcatttgattgattttcttttgagacggcttcatacccatttgcatcatcatcattctcagcatttgttcattaatcggcggatttttcttcaggtaattcatcatatatttacgggcgatgaaaaacccgattgctgcgcctgccaaaagagcaattagggctacaagaacgaacacccaaatcataatatacctccttcactcacatacagtgtactaaatccatttgaattatacaatacttgttttcttctcacacgaattttctttctttaaccggttttatccagccgaatcgtttatggtcataatcgattgcaagcaaatctcctttaaagttcctcagaatttcaaaaacggcggtttctgtatcataactcccgtatacgttcagctggagcattctttcttctatggtcacttccagcacctgcccctctttctttgaaagaagttggcaagcgcctgttttcgtcatgttgctggtgtcagaaaataacggctgcaagacatgatggacagacaagagcggaatcggctttgtaatataatggatctgtctgctgaggacatttttcaaacttccggaaacgtgcgcatactggtgaaaaagattaaaaaacattcgttccctgccgtaataatattgtgcaaactcctcttttatcagatagatagaataggaccgcatatgatctcactcccgcaactttgttaccttcactataatggacgggcctcaaaaaagttgtcgtttgttgtaacaaaatttaaaaaatgaatttgaaacatttgattgcatgtacagacaagaaaataagcgtaaatacatcaacgcgctgccgattatgcggtagcatccaagggaaaagccattcagctcagcccccgcacttttagtcccccttttcttatacccttcctgcataaaaaatgagcctgctttcgcgaataccgcaaaagcaggcccggaacgattacatgcccaataatttttttacacgtgccacaacattttcaacggtaaatccgtatttttccataacggttttaccgtttccgctggcgccaaacgtattaaccgacaaaatatcgccttcatccccggtatacctttcccagccgaatggtgaagccatttcaatggcaaggcgttttttcacctgtgccggcaatacggattctttgtatgctttgctttgctgttcaaaacggtcccatgacggcatgctgacaacagcagcatcaatcttttgttccgccaattgctgttgcgcgagcacagccagatggacttccgacccgctggcaagaaggagaacgtcagccgtttctttttgtgcaggggacacgacataggcaccttttgaaacgccttccaacgctttttcagacgtccctttcaaggttggcagcccttggcgcgtcaaaacaagcgctgtcggatggttttcagatgacagagcaaggcgccaggcagccgccgtttcattgccgtccgcggggcggatgaccgacaagcccggcatcgctcttaaagaaggaagctgttcaaccggttcatgtgtcggaccgtcttccccgacagcgatactgtcatgcgtaaagacgtacgttaccggaaggcccataagagcagctaggcggatggcaggacgcaaataatccgagaaaacaaagaacgtgccgccgtatacatggacaccaccatgaagcgccataccgttcatggctgcgcccatcgcaaattcgcggacaccgaaccaaatattgcgcccttcataggcatccggcatatagtccttgtcttctttcagccgcgtattgttggatccggcaaggtctgcagatcccccgaacaaagacggcaaatgtttggagacggcatttagcacttccccgcttgccgcacggctggcaagggttttgccttcttcatagaccggaatgtccttgtcccatccatccggcagcccgccttttatcgcctgttttagttcagccgcaagctgcgggtattgtttttcataggcctcaaacagggacgcccactcctgttcctttttcacgccattttccacaaccaattcacggaaccgtgcgtaaacttcatccggaacatagaagtcttcttcaaatgtccatttatacgcttctttcgttagtttcagttcatcttctccgagcggggcgccgtgggcagccgatttcccggatttgtttggagaaccgtaaccgatgatcgttttcacttcaatgagtgtcggccgacttgtatccgcctttgcttcctcgatcgcttttgcgacctgtgccatatcattcccgtcttcaacccgcaaatactgccagccgtatgctttaaaccggtcggcaacactttcggaaaaggccttatttaagtcgccgtcaagggaaatgtcattggaatcgtacaatacaatgagacgtcccaattttaagtgtcccgccaatgaagcagcttcggcagatacgccttccattaagtcgccatctccgcataaagcatatgtataatggtcaatgacagggaaattttctttattgtatacagccgccagatgccgttctgccatcgccattccgactgacatggcaatcccctgcccgagcggaccggtcgttgcttccacgccttccgtatgcccgtattccggatgacccggggttttgctgccatattgccggaaatttttaatatcatccatgcttaatgcataaccggataaatggagcaggctatagagcagcatggaaccatgccctgcggataatacgaaacggtcccggttaaaccagtgcgggttttccggattatggttcaaatatcttgtccagagggtgtatgccattggtgcagcccccatcggaaggcccggatgaccggattttgctttttcgatggcgtcaatggacaatgttcggattgttgtgactgccagttcgtccgttttatcaaacatctgttaacatcctttcttcatgggttacaactctatattaaggcaagtgaaacccataacacaactcttttaccattttgtatggattttgtaagaaaaaagcaggatggtttcctttttagtgcagctttctttttgtttgaatttgcttaattttttcaggggtaacgtcctggccagccgggtcaagcacacggacattttcaatcgtttttctgaatgaagagcggaacgcctgcaaatactcgcttcgcaattttgactgttcctttgcttcttcacttgtcagggcgccggttttcgcttttttcgccaattcgttaatccttgccattttttcttttgaaagcatattttctctccttttatccgtaattgatgccatcttactaaaatatggacccgcctgcaacgaaagcgcacccgtgaaacggttttgatactatttatcatgccccgtttcctccatatattccctgtaacgccggtggacggttgcttttgaaacttggtagccgaaaccgcgcatagtcgcagcaatttcttgaaaagtcaagccgttatcccgcaggcggataatttcttcaaccggcacttcctttcgctccctgccgtccggattccgcttcccttttaaatttttttccggacggtagccgtttttgactgcacgctccattccccttttaatttttaagttatgcagctttcgctgatactcttcaaccatgctgacaattttcagcaccattgaatcagattccgaaagctccaattctccgttttgcgcataacaatatactttaatcccttttttatataaaaaatgaagcaatgcaatttttgcatttcctcttccgatccgtgtttcatcctgcaccagtacggcgtcaatcttttcattttcaatcgtatcaagaagatcaaggatgccgggcctgtccaggtcatagccgcttgcccggtcacagatcaccccggccacttgaaaaccgtgggaatccgaaagcttctccagctcttcccgctgcctcgccaaggaagtttcctggctttctttttccgtgcttactctgcaatataaaacaactttcattttttcgtctcccgttgtgatttcatcgcaagttccctattatcatcgctgaattcatttttttctattggaatgacaattttttcgccggctttgatcatgttgccgtcaatatcattatgacgctcaacccagctgataaatgcttccctcgacattttgcccttttccgcatactgcccggcgatgttccaaagcgtatcgccctctgtgacgctgattttgatatagtgtggggatggatcccgcagacttccaatcatgaaaaatccgaaaacaagcgtaagccctgctaaaatcataacatagttatactttttccataatcgtgacatctccatcttcctcccgcgaatattcgttcgtccaatcaccagttctattataaaacgaacgcctgtttttcgtcaacattttttcgaacttacgtttgttttatctgctgcaatatgatataataatagcaaataatggcattcctcccgtaagcgtccccatacgcagcgcgggtgccaaacaaaactgtgacgaggtgaatagaatggcaaaactatcaaaacgacaacaggcgatacttgatttcatcaagcatgaagtaaaaacaaaaggctatcccccttccgtgcgggaaatcggccaggcagtcggacttgcttccagttcaactgtccatggccatctcgcaaggcttgaaagcaaggggttgatcaggcgcgaccctacaaagccgagagcgattgaaattttggaccatgatgaagaaataccggcccaaaatgttgtcaatgtgcctgttgtcggaaaagtaacagcaggcataccgattaccgctgtagaaaatattgaagagtattttccgcttccggaacatcttgtcccgtctgacgagtccgtctacatgctggaaattgaaggggacagcatggtggatgccgggattttaaacggcgattatgtgattgtccgctcccagcagacggcaaacaacggagatatcgtggtcgctatgacagatgaaaatgaagcgacagtaaaaagatttttcaaggaaaaagactacttccggctgcagcctgaaaaccagacaatggaaccgatcatattgaaaaacgtcaccattctcggcgttgtcatcgggctgtacaggcaaatggtgcactgatcaaaaagaagcagtttcggctgcttcttttttaatagagtatatgcgcgtttgatagcaaacatacctgtggcacggatttctgggcattcaatctattttcggaggaaaaatcggggaaattaatgggcattgggcgttcgccgcaaaaatgcccgataaacaaaaacccctcaaagccttacgcttcaaggggtttctttcttaatacatttcaatatactggtcgcgttcccattggtggacttgtgtgcggaacatataaaatagaagaaaatcaattcaaaacaattcaatatggtagccacttcttcgctattgctcccaaaattaatgactttccctcagttcttaaacctggcgaatgcgggcccgcctgtgagatcgatgagcgaaaactccacatcatccggtttttgtaaaattaggcttgtgatgagggatttcatgatgacagattttccaaaacccgttgttctggctaaaataaggtgtttccgcatgtcgaagtcgtggtacaattttcggcatgattttgaccaataagcacggaccaggttcccggttttaaacagtccgttgaccatagaattttgagtgacaacggctgcttatacacccggatttttagcaaaccgtcataatacattccgatttcctttttggcggtcattttttttcgcaaatatacttttgagctgtttaatcactgcccggtctaatttaaggtttttcagatctttgatctacagtttcatccgacgactcaccagaccagcttccaagctctttgtttgacaacatagtcctcgaaacttctgccaatggtatccgacaccggtattccgtgccccattcgtaatcccgttttttgactagctgtgtagtgtacgtttgtttgccatctttgacgtttaccccgatcagcgaaaaaatctcctttatttaatccgagtcatcatttgacaaaccattttttgccaagtatgcttttgtcgcgatcccgcccactcctcccttcatctgcaacactcctttgtaaattacggagtaatttgttgctaaaatcaagaagttccaaaacgacccacaaagcatcgctacgcgtggatctggaatattcccgaactaccttctccagcggcatttgataaagcaacgatcgggaaggtggaaatatatcttgtccatacaaaataacttatgattttctgaaagaaatttgtaaaggtaaataataaacttgtatcgaattacatacaatgggtgatgagattgaaggatgataatgttatagttttattgggagcatggattaagcagtcaggaatcgatcgcaaagatatttgtaataaatttgggatttccgcaaataccttatctaattggtgcacgggaaaaacatatccatctgttccgcagctcctaaaactttgcgagctcttaaacgtaaaatttgaggacatatataggaaaaaggaggaaaacaaatgagtgcatttctggggctaattggaaccgccggcataatagtcagtatcgttttaatgattttggggcgggttactaaaaagaaaaaacacggattgacagtatttttaatatctcttgtgttttttatcgcggggcttgctatcccaagcaacaatacgggggaaaaagccaccgataagaaaactgtaaaaaacgtttcgaccgctccaaaagaaaatgccgagaaaaaggaggcctcaaagcaaatcaaggataaggtagcaactgccacaactgctgaagaaccaactccaaaaaaggaagctaacaagactaatgaaaatattggcgaaagtacagtagcagcactggaaagtaacgactttatgaaatttgttaacgaatataaaaaattgggtggcaataaaacagcggtatgggataaacaaatatatggtaaaaaggtaacttggactggaacagtcgaacatgcaggaaccagtgaagtatttgtttatggaaatgacgattataacggagaaacttggggcgaattaggggacaagaaaaaattattttattgttttgttgcgaaatataaagatccgtcccaattcaaaaatataaagcaaggagaaaaaattacagtacgtggaaatttaacgtctcgaggggattacgatttaaattataattggaaaatttacaatgcagttttggtgaaataatttatagccccctgcaaacgtgaggcgtttggtgagctgatgaaaagccggatctgggaacacattgacactgcaggatataggaaaaagtacacagcaaaagaattggatatatcgccgacacagttatcaaactgaataagttgacggtcatactctacagtggaaaaggcttttaaattggcaaagccgcttagatgtaaggttgacgatttactaggaggatgatgaaaatgagctttgacacaatcgcgtcactgcaaaggatgcagcagatgcaacaggcggaggctgcagccggtaaacgcctggtgttaagaaggttgaactccggcgttgatattggactgacgattgccgcgtttttattaatactgcccacatttactttgtcactttggcttctgctgatttacctcacaattaaagaagcatgcaccaaaacatgcttggtgaaaaacgttgcaactggggaaaagtttagagttatgaaatcggaatttaaacaatataaaagaatggtgaaaagcaaagaaaaagaagtgaggagtatcatcccggcagctgcagcgattgaagagccaccagcctcgcctgcagaggaagaaaaaacagaagttgaaccgccagttgttaagaggctgacacccgaaccgctaccggatccagtaattcaagaacagccagaaatagttcaaaaacccgagcccaaacctcagccgcctaaaaagaaaagcatcacctttaatgtttccggggtgacatttgaaaatgataaaggtaaggaaattcaacctcttttgcgtcggattgcccgcgagattgcaaaagagcaagatgttgagtcgtacggtggatggacaaataaagacatcttggaatttatggctgaagcttcggaatttgaagatgtgatgtttggggactatgtatcatttgaaaaagagccagacaatgaatttgaccaaaatgccataaaggtaatggccaatttgaacgaaaagcaatttcatatcggatatgtaccgaaagaatataatgtccaggtctgtaaattactggataatgatttgattgacaaagtaacggccagttttgtgggcggaaaaacaaagaaagttgactatgattttgagaaggataaagacgttgttgtaattaacgagctcactttgggagtagaaattacattgactttgaaagaagaagagtagcccccgcaaacgcgagggcttttttgctttttattatagcacataaggaacacaggttctataattaaattatacaatattttgtcgggaggaaaaggcgatgtgaataatttgaatctcaatttttacgactataaacgaaaaaattccaagcagacgtctgggaatatcgaataacttatttggaccaataacgaaaaagcaacgtgaaaaatcaaagaagggtttcaactcaaaagaagaagtaaaggctgccgctgttgaaattgtacatgttaccatgcacaacacttttgaaaaagctgtgacaaccaaacttatttttgacaaaccaaccaaaggggtgagcataaaaagggaaaaagaaggaggctcttatgttcattgaatctgacaaagtattacatctgatgtatacagccatatctcggaaaaaatcgaacgtgagaaaatcgaaaagtttgatgactattacagccggatcaaaaactgaaatttttttggtcaaattttggtcaactaattattcaccacccaaaaaaagcaatttgaccaaaatacagaaacccctcaaagccttacgcttcaaggggtttcttgcttaatacatttcgatatactggtcgcgttcccattggtggacttgtgtgcggaacatatcccattcaatttcttttgcttcgaggaaatgttcgagaatgtgatcgccaagggcgtctaccattacatcatccgattttaagttttccagcgcctgcagcagtgtgcccgggaggtcgacaatgccggcttcttctctttcttctttcgtcatgacatagatgttgcggtcgaccggttccggcgcctgcaatttgttcgcgatgccgtcaagccctgcttttaacaggacggcgagcgcgagatacggattggcagacgggtcaacgctgcgcacttcaacgcgcgtgcttaagccgcgggaagccggaatccgcatgagcgggctgcggttgcgggcggaccaagcaacataacaaggcgcttcataacccggcacaagccgtttataggagttcactgtcggatttgtgacagccgtaaagttcgaggcatgcttcatgatgccggcgatgaactggtatgctgtatcgctcaactgcaattctgtatcgttcgggtcatagaatgcattttcttttcctttaaaaagcgaaagattggtgtgcatcccggaaccgttcacgccaaacaacggtttcggcataaacgtcgcatgcaggccatgtttgcgtgcaatcgtcttgaccaccagtttaaaggtctggatattgtcacatgccctgactgcatccgcatatttaaaatcaatttcatgctggccaggcgcgacttcatggtgggacgcttcaatttcaaagcccatttcctcgagttccaatacgatgtcgcgccggcagttttcgccaaggtccgtcggcgccaggtcaaaatagccgccgttgtcgttcagctccagtgtcggttcatttttttcattcagcttgaagaggaagaattccggttcaggcccaagattaaaactcgtgaagccaagttcttccatttctttcaatacccgtttcaaattattccgcggatcaccttcaaacggggtgccgtccggattataaatatcgcaaatcagacgggcgactttccctttctcagcggtccacgggaaaatgacccatgtatcatagtccggatacagatacatatccgattcttcaatccggacaaacccttcaatcgaagagccgtcgaacatgattttattgtcgagcgctttttcaagctggctgagcgggatttccacgtttttaatcgtccccaaaatatccgtgaactgcaagcggatgaatttcacattttgttcttcggcattcttcaaaatatcttcacgtgtaaacttaggcatgaacagtattcctccctttaggcaataaaaagtatatatctaagctataaaactagcttttcaacaatgttaatggaaaaaccggggcgcatcggacaaccgctggctcggtctttgaaaacggccggcctgcagcagttcctggcgaagccgtttgcggatttcttcatccgttacatgatttttgacgagtaccggcccggttccgcggcggtcgttcatcaataagatttttttgatgcctgcaatattgatcccctgatccagcaaatctttaatatcaagaagccggtcgacatcatttaaagaataaaggcggcgattgccttccgttcttgccggtgtaatcagctcgtgttcttcataatagcggatctgccgggccgataaatctgttagcttcataacggttccgatcggcaaaagcggcatcgaacggcggatttcttttcgacccatgttatacgctccttttctttatatttttactatattccatgtgagtttttttgtcaacaaaatgttatattttctcacatcattttttatcctcaggaaggcaaaacgagtttttcgcggatttccatccattctgccacgttcacactttcttcaagggcttcaagacgggcatcgaactgttcggcaatatcgagtaaagcttccgattgcattttcgcaaactcttcctccagccatgagcggaacgaaccggcaagcttttctccttgcacgtcaagatactgctgcgcaagcggttcaaacatcgcctgcagttcttcctgcatgccggcttttccccctttttcaaaaaaagtgcgcgcatttttaaaatggcggaatgccttttcaaacggttccaaatccgtttccgaaaaggccgcaggaaaatcaggcgtagcgtgtgcgcccgcttcaaacgtgctgacagacaaatcaggaagcaaacgtttcatctccctgttccattccgcgctttgcgatgtgaataatttccggcaatgggcttcaagccttacatttgtcgcccgcatctcctgcgcaaaatcatagccaacgagttctgcaagctcttgaagggcgcccggcaaatctttcgctgccttcaccgttgccggattaaaagcttccttgaaaaagtcggcgaagcggtagaaaacgcgctgttttacgtaatagagcagctccttctgctcctgcatgacgctgtccgtgaaaaacgccggctttgtatttttcaaaatggcttctgcctcttcccgccgtttccggagaagttcccgtttcgctttctttgtttcaatcgattcattggcatcgcggatcacggcatccaccattgcaaggccgcgttccagctcgttttgtgcagactgaagcaccatattcagcaaatcatggtcgagaaattggcggaagcccgcttcaaattcggccattttcgcttcctcccgcctgcccgaaagcgcaagcaggcttgatacaccataaaggcgcggattgtggatgccgaaatggagcagctgacccctgacatagtccatcacttctttatattcttcgccggacgaggcaagatcaatcgcattgacaataaaaaacatcttatccagttcaaatgcttcttttacccgcccgagctggatgagaaattccctgtctgcgcgcgcgaaggcatggttgtagtatgtgacgaagaaaaccgcatccgagtctttaatatattcaaatgctacgccggtatgccgggcattgatcgagtcggctccgggcgtatcaacaagcgtaatgccaagtcttgtgaacgggcaatcataaaataaatcaatggattcaacaaaacaagactgggtttcatcggcaacaaaccggcggaacgcttccatcccggcattcaagttctgtccggcccgcccgttaaaatcagggaagccttttgcaaaggcacgcaaaaaagataaatgaactttttcgtttgctttgcccgtttcttttgcgtgcaaagtttcaattttttcaagcacttcctcgaacgaacggcaactatgcccgaaaacagcaagcgacttgtttacatcttccagcatctgcgcctccgttttcagctttacggctgccgttttatgcggatgtgccgcatcaggcgggcagatcctgcaaatggccgctgttgtcggattcggtgaaaccggcagtactttttcgccggcaagcgcgtttgcaaaagacgattttcccgcgctgaacgcgccgaacagcgcaacggtatagcggcggtttttcaggcgcctgcttttggttctgagcgtttcggtataccgcccgaaaccgtgctggtgcttaagcagcgtaatcgcctgctctattttggcaagcacggtttcaggcggcaatgtgccggcttgtttttctgtcgggcccgggctttctaaagccttgccggtttcttcaggctgttttgcatccttttccccgcgatacacccggtaatgcgccttttcacccgcccattctttctctatttcagccagcagctgttccggatgtgcggcaggcgctttcaattcagtccgtttttcggcaagctgcctttctattttttcgagattcctgtaagcctctgccagttcttttgcctgcacggcctttttccgaaccattttaagctgttcatccgtttccaaggcagcctgtttcaggacgagcgctttccaatcgttccaagcctcacgggcggctcgtttgatttcatccgagacattttcgcaataatggaggatatagtcgcctgtcagccgtgcaccctcttttacctgggcggcgagcattgcttcgctgaaatctgctttaagcatgccggcctgttgttccagcatttgcgcgccagcaagatgcagcggttttaaagcttcttgcgccagcgggcggagatgccagtcgatttgtgcttcggtattggcttcgagggcggcatagaaatcatggagccgctgttttcttgcttcttcggtttttttcttctttgcaaaaaaaacgccggcatggaaatctttttgcatgctttcaagatacgcctttgctttctctctcgtttcaaacggcattaaataggcgccgtccagaaacgtttgaagcttttgccgcgtatcctcatcccaattttcaatgcgggtaagaagcgcccgttctttttcaagccactcttgttccgcttcgtacgcttccgttttcccggtgcccgaatattttgcaagcacttcctcatatgctgctttttgcggtgcgtactgcgcttcaagccagtcgtcatgctctttttccaagacgcttaaggatgcttcaacagaccgttccagtcgggcggatttttcggaaacggcgtggtcaatgagcgctttcagccggccgaattcattatcgggatgatccgggtcttttaaagaggtgtaaaaaatgccgcccggctggacatgccaggatgcaaatgcattttcaacccctcgccggaatgcggaaaacggcagctcttcgctctggtgcttgtcaatctggttaataattaaataaagttcaagcccgtgatcgagcagttcttttgtaaaggtaaaattgagttccgactggacatggttgtaatccatcacataaaagacaagatccgccatataaatagccgattccgtggcaatccggtgcgcatcgtcggttgaatcgacacccggcgtatccatcaccgtcaatcccgccggcaaatcggaatcgggctttgtgatttcaatttcctggacatgcccttttttgcaataatttttgacaacttcaaaatcatacggcgcgtgaaaaatcaaaggggcttcccctttttcataaacgatggcacagtcttccgtccccttttcaattttgacaagattggcgctcgtcggaatcgggcttgacggaagaacacggctgcctaaaagcgcgttaatcatggtggacttgccggctgaaaaatgcccgcaaaacgcgatatgaaagtcttcgcggcggacttttttcagcaggtttttcgctttttccaccctttgttcatccccgttttgccggaaatgttcaattaagcttaaaatctgtgttgtgtttttgcttttttcctgtagtttggccatcactttactccccattgtgtgttgatagctctattttaacgaatttttcatcgtattcatactatattagactcattttttcccttgcctgggcgaatgctgcggaccgcggataattttccggaaaaaaacctataatatggctgtatcaggaggtgaccgcagatgggattattccgttccctttctgcctggcagtccgcaagacgtgaaaaatacatgtccacgatgcaggaacaaaacaaatgtccggattgcggcgggcgcggttttatcatgccggccgcatacgaatacgcttatccgtttgactgttccggatgcaacggaacgggctcctttcaggaatggcagttaaaccggcagtagccgccacacttcggcggcttttgttttgttaaaatattacaggattttcctcgcctcagcgtgacggcaatatgccggcatgttatgatgaagtgaagagaaaataaaagaggtggggataagatgtccgaaaagaaagcttggcacataaacggttttctcgggattttagcgattgtcgttttcgcgcttctaggtttgtttttcctttttgccgtcaatttttttgccggtattgtcctgcttgccataagcgtcctgcttgtctcgggaatttgtgtcatccaaccgaatcaggcgctggttgtcacttttttcggccgctatataggcgcgatccgggaaagcggcttttacgtaacggtcccgctcagtgtaaggcggcgcgtttcgttgcgggtaaggaattttaacagcgccaaattaaaagtgaatgacgtggacggaaatccgattgaaattgcggcagtcatcgtgttccgtgtagtggatgctgcaaaagccgtgtttaatgtggaggactacgaggaatttgttgagattcaaagcgaaacggcgctccgccatgttgccacaaaatacccttatgacagcgcggaggaagaaggaatttcgctgcgcggaaacggggaggaagtctccaaacatttaaaagaggaacttcagccgcgccttgacgttgccggcgtggaaattatggaagcgcgcctcacgcaccttgcctactctacagaaattgccagcgtcatgctgcagcgccagcaagcttccgccattcttgccgcccggaaaaaaatcgtggaaggggcagtcggcatggcccagatggcgattgcgcaactggaaaaagacggctttgaactggacgaagagcggaaaatggtgatgatcaacaatctgatggtttcgattgtatccgaccgggccgcacagccggtcatcaataccggcaatttaaattaacccgaaaaaagctgaaccggattccggttcagcttttttcatgctgtcaggatgcctgtgtcccgacttttttcacctttgcttttgcctcttgtttattcggaaggatatggaaaaaaagattcagcacaatcgccgtcacactacctgcgacaatgccactttgcgtaaggagctggatattcgacggcaaacctttgaaaatatccggtaccaccgtgacgccaaggccaatcccgattgaacaggcaatgataaacaagttttcgttattggcgaaatcgactttgcttagcattttgatgcctgacgcaatgaccatcccgaacatcgcaatcatcgccccgccgagtacggaagatggaataatcgtcgttagggcgcctaatttcggaatcagcccaaaaaggagcaaaaaggagccgacaagtaccatcacgtttttcgatttcacgcccgaaagctggatgaggccgacgttttgagaaaaagcggtgtacgggaaagcattaaataatccgccaagcatgacggcaagaccttcagcccgataacccctcgcaaggtcatcttcatggagcggctgtttggtgatcccgcttaaagcgaagtaaacaccggaagactccacaagactgacgagcgccacaaggatcatcgtgatacaagcgctccactcaaaagtcggcatgccgaaataaaacggctgcacgatatgcacccacgaggcttccgcaaccggggcaaagctgacctttccgaacaatgcagccgcgacggtgccaattgccagcccgattaaaatcgagatcgaacggataaacccttttgcaaaccgctgcaaaaggacaataatgagcaaagtgccgaatgaaagagcaatattggttagggagccgaaatctttgcttccgtctccgcccgccatatctttcatggcaaccggaataagcgtcacgccgataatcgtgacaaccgacccagttacaactggcgggaaaaagcgggccagcttgctgaaaaatttgctgatcaaaatgacaaacagccctgatacgagaatggcgccgtacacagctgaaacgccgtactgcttgccgattgcgatcatcggcccgacggcggtaaaggtgcagccgagcacaatcggaagcccgatgccgaaaaaccggtttttccagatttgcagcagtgtcgcaaggcctgacatgaaaatatcaacggaaacaagatacgtcagctgcctgctattcattcctagggaactgccggtaataatcggtacaatgactgcgcccgcatacatcgccaaaacgtgctggagcgccagtacggtcattttcgttttttccggtttcatttggcatgcacctcctcttgaaatgtgaccgtaccgttttcaagcgaccgaatggatgcgagcgactccacgcggatgccccggtcgcgcagcctttttccgcccggctggaatgctttttcaatcacaatgccgatgccgcaaagttcagcccccgcctggtctattatatcgatcagcccttctgctgcctggccgtttgcgagaaaatcatctacgataagcacccggtcagcttgatttaaaaaagcgcgcgaaacggaaatgatatggtttgtttgttttgtaaatgaatggacggaagcttcatatacgtccgcgtcctgcgtgaacggttttcttttccgggcaaaaaccatcggaacgtttaattcaagtgctgtcattaatgcgggcgaaatgccagaagattcgagcgtcaaaattttggttacaccatcctgcttaaacagcccggcaaatgtttccccgatctgtttcataaggacaggatcgacctgatgatttaaaaaagcgtccactttcagcacctcgtccgaaagcacgatgccatcttttctaattttttcttgtaaagctttcaatgtttttcctcctctttgccttcgctgcattgatcttgattgaaacatgcggccttcagaaaaaaagcccaaaggccgctgcacccacaaaaaatggagtaagcaacgcctttgagctttttcatgtgcaaaaaggaaaaggaacatccacaacgttcccattgcccacccatagtcaggccgtttacggcagcctggtagaaacttgcgggccatattcccgcgattatatgagtgaatgcgttcagtttttataataaaagtataagggtatctttccggcatgtaaagacgaaatttccgaacggcggattttccgtctttctttttgttcgcgtttggcaaaatgcaggcaacatccgccgaaaattttacagaaaagtcggcgggcaacatggatagaaaaaccggaatatccaccgttttttccatcgttacaattgcctgtgttagggtacgcacaccggatctgcagcatacgcaggtttccggttttctttctgaaaccggcggctgccgcactgtttgttagccgaaagttctatcttaatctttgatccggtatacatcggtatatttttcggttaagtaatcaatcaagtatttcgggttgagcgcttcaccagtggcatcgcgcaaaatatcggcaggttttttcaatttgccgaaccggtgaacatgcgccgtgagccatttccgcaccggctccagattgcccgattccacaagcttgtcaaaatctggaagcgattttaacatcgcatgtttgaactgggcggcgtacatcaggccgagcgcataagacggaaaatagccgaaatccccgccggcccaatgcacatcctggagtacgccttctccgtcatgtgccggccggatgccaagatagtccacatatttcgcattccagatttccgggagttccccgacttcgatttcatcattgaggagcgctttttcaatttcataccgcaccataatatgaagcggatacgtcaacatatcggcttcaatccggatcagggatggtttcgcctcgttcactgcacggtaaaatgcttcaagcggcacgtcatcaaactggccggatgcaaactgtttcaaaagcggataatttttcttccagaacggaaaagaacggccgatgatgttttcaaaaaacagggattgtgattcgtgtatccccattgacgcgccttctgcaagcggcgtacccgacaagtcttttgaaatatgctgctcatacaaagcgtgcccgccttcatgcatgacgccgaacacatcgacgcgccagtcgttttcattataacgtgtcgtaatccgcacatccccctggttgatgccggttgcaaacggatgcaccgtttcatccagccgtcccgcctcaaagtcaaagcccatttgctttagtatttcaagcgtaaacgctttttgcttttctttcgggaatgggtgaaaaagaaatgccgtatccggtttttcttccgacatactgattttctggacaagcggcacaatcgcatctttcacttgttcgaatacacggtcgagtacatcgaccgtcatgcccggttcatacagatcgagcaggggattatacggatggccttcatacccccagtagcggacaaatttctttttgaatgccacgatttgttcgagataaggcttgaacaaggagaagtctgctttttcctttgcttcttcccaaacattttccgctttcgagacgagcaccgtataagcctggtattcgtcaggcgggatttttttgctgcgttcgtatgttttccggcattcttccaatgtaccggctgtccgttccggcaattgctgcttgtgcggcaaaagcttctccaaaaattcggccatttcttttgaagtttgcatgtcaaagacttcacccgataaaatgccgatcacttccgcgcgctgcccgacgccttttttcggcgcgccggtccgcaaatcccagtatatgagggcgagcgcttcttcataagctttgatttttttgacatatgtcaaaaagtcctgctccagtttttcaatcgactctgttcccatcatcatgcctcccgtcaaatcacttgcacgtccatcttatcatgtttcacgcggcgcacaaacgataaccattcggcttgcttagttttctgttttccgcggcgggcgcggtccccaaaactggtacagatcggttttgatcgacccgttataaagctttctctttttcgtcgcttttttgccgtatgcgcgttcaaactgttcgtccgacgtcaaaatataaactgaccatgtgtcaagcttggcaaatgcccggcccatctcccggtacatgttttccacttccgtccgttcaccgattctctcaccgtacggcggattgcccacaatcgtgccgtatgcttcctgcgccgtaaaatcggccacctgcatctgtttaaacgtgacgatgccgccaagtcctgcctcattggcattttgccgtgcgatttcaaccatcccagggtcgatatctgaaccggatatatcaagcggctggtcgtaccgggcgagatcttccgcttcttcgcgcgctttttcaaagacggtctcactcatccacggccatgtttcgcataaaaaatcgcggttaaaacccggtgcaatattttgcccgatgagcgcagcttcgatcggaatcgtgccggagccggaaaacggatcgcgaaacggccggtccgggtgccagtttgtcagccggatcagcgcggcggcaagcgtttctttgatcggcgccggcccttgcgccgcgcggtagccgcgtttatgcagcccggccccgcttgtatcgatcgtaatcgtggccacgtctttcaataacgccacttcaattttaaaaagcgggccgttttcttcaaaccagctcgttcctttatagcgggactttagccgttcaacgattgcttttttgacgatcccctggcagtccgggacactgaatagctttgacttgaccgattttccggtgacggggaactcggcatcgcgcggcagaaaatcctcccagggaaccgcttttgtcccttcaaacagttcatcgaaagtttccgccttaaattcagcggctttgattttgacgcggtccgcgcacctcagccaaagattggcacgggcaatcgccgattcatccccggcaaattcgattttcccgttttccaccgtacagtcgtagccgagtgcgcgcacttcttttgctacaagcgcctcgatccccattgcgcttgtcgcgatcaattgaaagtcagacattttcccaccatctctcgtctaatatttcttattgtatggcatgccgtaccaaataacacgttttaaaaaattatgtataaaaaaggccgggcgcctgctgtatatcaaaataccgcagcgccggcccgattcttccgattcagccagaataacgttctgtaagccatgttctgtgcctttgtactgcaaacgatgtggcgtcatctcgtacgaaggcggtaatcatctatctacaagcaatacgcttgtctctttcctcgttcatttcctcagaaagagtgcctctaccatgatttgagttgctcacttgcggggtttacctcgttccacctttacggtttcccgtaaagcttcgtcactgtggcactttcaagggtactccgccatgccgttaaaggtttaggcgttttccctgccgtcagccttgaatcaaggctgccctggcttatgaattcgccaggcacaaacactacgggcatctcagcaccgtgcgagcatggactttcctcaacagccgttttcaggctgcagcgattacccgaacgttattcacaacgcttatctattatataaaaagaaaccgggacttgcaagctgtaatttttaacggatgtgtcaatttcttccccctgcattgccataccgggttcgggcaagcgattgtctgttttttttatgccgcttccccgtgcccttttctacagaaaaatttcacacattttttagccggctattcatttaatttgttgccgaaaacatgtttttcaagattggacagccgttttaaaatatcgaaattcgttgtcccggtcatttgctgtacaggctgccgttttgctagttcttccgcctgctttttgagccggaggttttcctgctggagctcctcaatcgtctgattaaacgtttcataatcttttatgatcagatccagaaatttgtctacttcttcctgccggtagcctctgacagccgttttaaactctttttccaaaatgtctttcgccgtcaatttaatttgatccgataacatgtttgcaccaccttacatctcccagacataatttcattttttcaaaaacctttttatttgtcaattgtaccacagcttgcctaaaaatctgtctgttcttcttctattattgcctgtaaatcgtaaaagtcaatgatgcggatgtcatacgggtgcgattcgctgaacttttttgcagcttcgaacaagtatttcggagacccttcgcgttcttcgtcatacacaatcatcaggcagtcgcttttatgtaagaaaatccggtttttattgcggaactgctgcgggctttcgtacggccttttcgagatggcggcaacaaaatcggcctgggaaagcaccatctcgtagtatgctttttgttcgtctttccacttttcttcctgcccttcaaacggcattaacacagcgagtttaagttccgggtattccgcttgtagatcaaaaacggtttcagcagcccaaagttcggtgccctgctgcccggaaatgagtacccattcgtacccttcatcgagcaattccactaaccgccttctgatggccgtttgaatatagcgaatacccgggtggtccgtcccgaatatccccagttcatacggtttataacctgtaatagcgacaacttttcccaatgcattacgctcctcgttttttgttttcctaaaagcaggacggcaaggattacccttgccgtccatttgtcagcagcacttcggcccgtgcggtttgactggatcaaaaaagttgctgaccgttcccgggtcggtttgattgacgtacgattccgtgtgcgggaagtagttttgctgatgaaatacatggtgattcacatgggttgtatgcgtcgggaaaacatgcggcacgatgacatcctggacggtgtgcgtaacgcagcattttgtcggatgcacaacagccggcatgatccgcggcgggcaatggtggtgaaacatgttccgatctcctttcatcatcagacgtcttttttcttacactactaacctatgacttggaaagggaacatgtactaaggaaaaaacccaatttgccgtttcttccaatccttgcccccatccccccatgtagcccggtgcatcgtttttcgacctctttaacaattcgttttgatcaaaaaccattttaacgggacttttggcgggctgcaataaaaatggcggaaatcgacaaagagcgcgcatttttctctgatccaaaagaaaccgacaaatcccaacaaggggcgtttcaaaatcccggattccccgtcgaatcatgcgcttgcccaggaaatagcggttaaaaaccggttcttttcccggacatttccttgctgacagaggatctcgccgggatttgggctttccggtacaaccgtaaaaggcgtttttccgtttccaaacagcattttttccatttccctgaaccgaacttgccgtacttttgataaatttccagtcccttttcggcatagcggacggcttgcaaaaggtcttttttcttgtgttcatacagtttggaaagctcaatgcacgcttcggctctgatcgtatccggcgcattttcggctaattccgcccaaagcattccggctttcctatatgctttttgttttttatactggaaggccagacggtgtttggcagccagatcattttcgcccgcggccgcttcaaaacttttcacggcggcatcatcttcgccgatatattcaaaccattttccaacaagccgtttttcctttgccgtctggtttggatcggtctccagaatttgaaacgtaaggtgggtatacaaagtaatgagcgataaaatgtcctcttcgttatggtggatgacaccaagcaggccttccggatttttgcgctcaacgaaatcaaaataaatcattggcgccaaatatcccggaatatcctcttcgcgttccactcctagaatttcacgctctacattcgctaatttcacggacccgagttcatctttccacagcctttttgccgcgtggtacaagtcaaaatggccaaattcaggcagacgcgggacgtggtcgcggataagcgtatggcgcgtctttacctggggccagtcaaacgccttcccgttatatgtaacgagcgcagtgtaatcgatattttccaggaaactgtagtaaagcggcacttcaagccccggttccagaagaatatgctgttttaaaatgacattttcttcggtaaaggaagcatatccgagcaaaaaaatcgtgttgcccgcccctcccccgaggccggtcgtttcggtatcgaaaaaaaacaaatcaaacgggctgtagcctttggcggataaagggtgccggaccggtttttgctgccacaatttgacggcatcaaaatagtcgcgaaaagcatatttgccgtgctttgtttcaagcgggtaacggacttcacggatgaggcagtactcgccatccaaatcatacagcgaagcgcccgccttttcccacatttcaaagaaaggaacagaatcggtccgggatgcttccacccgttcggcaggctcaggctggtctctcacgatatggtttttcatccggtttaatttatcttttaatcccggcatgttgcgcccctcctttgatcgccccgagccagaaatcaaacagccggacggcggcctgctttgcgcccgcggcagccgtttctgcgcccgtacaggaagggcacccgtcttcgcaagggcagtttacaaccatcgctcttgcagattccaaaatttcccttgccccgccatagattttttcgctcaggccgatgccgccaggataccggtcatacaaaaagattgttggcttttcgtcatggatcgctttcacttggggcacggcctggatatcatgggcgtcacacatggcaaaaagcggcgcaatcgactggagtgcgtgcgcagcgccggtaagcgcgccttccagcaaatgtttgggtaccgcgtcttcccccatggaaaaccaaacggcattcgtgtgcagttccatttccggaaggtggatcggccccgagccaatgttttcatgcgtgttaaatttaatttttttgaaaatcgtcggcatcgcccggaccatcacatccccatagccgataatggcatcctgcaaaacggtctctcggtcctgttccagcactttcagctccaccgccagattggcatccgtgtaataatcaacagcgacttcacggacaaaggcttttttctcttcccagtccagcttttcaacctgatactgcaccgcctgatgcaaataaatcgcctcttcatggagcaatgtcatcgcgctgaactggtccatttcaccgatcacgcgcacatccggcgcatgggtcatatcgataatgacgacattttcctgcgacgcggaacgaaggctgatattgtgggccggaaaagcatcattcatccagtaccaggcatccccgcgccggtggagaatccgttcatccgctaaaaactcgagcacgtcctcgatttcaacgccgccaaacgtttccccttttttaaacggtagttcgtatgcagcgcatttgacatggtcgactaaaatgacaagattatcagggttgatgcgcgctgtctccggggaccggttgaaaaagaagcccggattgcggatgatgtactggtcaagcgggcttgagccggcaacaaggatgacaagtgattccccctgccttcttcctgcgcgcccggcctgctgccaggcgctcgcaattgtgcccggatagccggtcataatacagacctggagctggccgatatcgacaccgagctcgagggcgttcgtgctgacaatcccgtatatgtccccatttcttaatccctgctcgattttccgccgctccgttggaagatatcctcccctgtagcccatgatcgacttttccccgagttcatcttttacgagttcctgcaagtattttaagatgatttcgacgcgcacacgacttcttgcaaaaacaatcgtctggattttgtttttcaaaagttcccctgcaattttccggacttcaagcgtggcgcttctccggatgttcaacggcttattcacaagcggcgggttgtaaaaaagaaaatgcttcgttccacttggcgcgccgttttggtcaatcagttccatttttttgccggttagcttttccgccagctctttcgggttttggatcgtcgcggacgtgcaaataaaaaccggatcgctcccgtaataacggcaaatccgctttaatctgcgcaacacattggcgacatggctgccgaacacaccgcggtatatatgcagttcgtcgatcaccacaaatcttagattttcaaaaaacgacacccattttgtatggtggggcaaaatggcggaatgcagcatatccggattggtaatgacgatatggccggctttgcgaacgcgctgccggatatttgaaggcgtgtccccgtcatatgtataactgtttaccggcacgccggcttcttcaatgatttcgtttatttcacttttctggtcctgcgcgagcgcttttgtcggaaacatatagagcgcgcgtgcatctgggttttgaaggatggtctcgagcacaggcagattataacaaagcgttttgcctgatgcagtcggggtaacggccgtaaaatcttttcctgccatggcaagctgatatgcctctgcctggtgggtatacaatgacgaaattcctcttttttcgagtgccgaaagcacagccggtgtgatgctgccaggaaaaggcaccgttacagccggctttccttcaatcgtatgccaatggacaatccgttcctggaaagaacggtccatctgcaactgctccaatatttcctgcaaattcttttttctgaacatctttcctcaccccgctatctattatatcgaatagacgttcgttttaaaagcattctttcacattttccgcttggttttcatattatacagcgaaagagtgctgtgcaaccattcattttctttatcatcaataagaaaggagcctgccgatgtccaatttatccggcccggatgaaaagcatcctttttacgggctgatgcaagcgatggaccaattttttcaggaaaaaccggtcaaacatttttttgagaatctcgatgaattttttttttttgatacgatcccggtccgccttgaagaaaaagatgaagcttatgtactgacagccaaactgcccagatatgaaaaaggccagattgagattgaagtttatgatcaatatctcaccattagcgccaggcatgaggaagccgtttcaagtttggatgaaacgaaaaaagcttacgaaaagaaaagcgcattccgccggataagccggacggtgcccctgccgccactggtggacggggatcagattcaggcaaaatttgaaaacgggctgcttgtgattttgatgccgaaaggaaagaaaaaaaagctgaggattgaataagaggccgggagcgtcccggttttttccgttttttgtcccttttttaagcaaaacggcccggaagcctattttgtaaacaggcccccgagccctttgaccatcgatgatacttgattaatcgcattgatcatctgtccggcagtattgaccattttattaaaatcaatggagccatcctgggatttgaaggaattcaaaaaagatccccccatttgcggcggctttggcggaacaggctgatgcgggtacggatggccgaaccctgccgcaccgtgctgggtgtttggcttttcagctgcctcgagcgggtttccgaacaaatgcatggcagcttcttccccggcatgctggccgctttgtccgtgcatatgccaggcctgaccgtacccgcccggatgctggccgtacggatacggcgctggggggtatccataaacatgcggggaatgctgcccgggatatggaaattgcgggtaatacggaccggcccccggcattacaggataccgtcctatgtttcttgtgcgccggctgctgtaaggatcttgaaaaacgcgcattgccatcgcctcctgcctgcttcaccaataatgtatgtggcatctggcaattggtgatgtgtccatatcctttacgatttctccaatgcttcctgcaagcattggagaatatatttcaccgactgaaaatggtcgagcatcattttgcggctcgatgacgggtaaaaagcacgcaccgcaaccatttgcaaattttcggccgtatgttcaagctgggacggaaaaagatgcgccggcctccgggcttccacccatgcttttgcggccgggagccacctgtcaatggcatcctgcaacgtatcgcaaaaaggcttgacttcgctgaaaaaatccttttccacccctgtttcctttacttcctggtacaggtcgtaaagctcaagcgtgtacgcaatcagctgctcgtttaacgcttgtaattgcccttcttccatttctgttcacccttctaaccggatattctcccttcgccgggtttttttacgggagacttctttcattttaggaagtttttttgttttcatcaatccgcaagctttccgccctgtatgtttttctgaatgcttccgcccttttttccaaatgatccagcttcatttctgcttttttcaaatggtaccactgctttatcgactgctttcttgcttccttctccgccttatgccggatctctgtcccaatattttcgagtgcctcttccattttttccagcccgtttaaaaatgcggctttcggtatcatttgttttcccccttgaatttcatcatgcctattcattctctgccaggcggcccggtcccttcatgcctgacaaaactagaagcaattcggcaaagaaaacgggtttcttcattttgcgttttctttcgacagcgtgcctccattttgggcgcatttttcccggctgcgccaactttcgtgccggcatgtatgcaaaaggcggaactgcaaacaataaatatgccggaaaatccggtgacaccaatttcaggaggtgggtttccatgaaaacgaatgacaacaaagcacaacaacagaaaaaagcacgggaacagaaagggtctttggcaaaaggagataagaagctgaacggccctgaccgcccttccacctaatgaaagcaaaaagcaaggaaatgtttccttgctttttgttttgcctgtttttagcgaaaaaaaccgggcaggccggttccttgtcccccgccggcgcaaaaggggccgaaagactgttttttttattacatattctttgtctgttctgctatgatataatttagcttatgaggtgagggaacatggaattgcgttatccaaacggaaaaaagtataaagggaaaaaaaacaaagccggacggaaaaatgcgaaccaaattttatacggcaaccgcgggatgacactggaagaggatctgaatgaaaccaatgcttattatttgcaggaaggcattgccgttatccataaaaaaccgaccccgatccagattgttcaggtcgattatcagtcacggagcacagccgtcattaaagaagcctattttaaacagccgtccacaaccgattacaacggggtgatgaacggtaaatatatagactttgaagcaaaggaaacgcaaaaccatacttcttttccgcttcataacttccatgagcatcaaatcagccatatgaaacaggtggtggcgcaaggcggaatttgctttgtcattctccgttttgcgaaggaagaagaaatttttttgctggaatcccgccatttatttttttattgggatagaatgcttgccggagggagaaaatcgataaaaaaagaagaaattgaagaaaacgggcaccctataccggttggataccggccgagaattgattacatcgccgttttaaaacaattgtatgctttatagttgttgcccggccggatgattgacggatccggcaacaatatgttttgaatctaaatcggctttttcagatttagaagaaaggaatgctgagcatggcagaaaaataccaatcccgcgaagaacgccggaaacaaatgcaggcaaatcaacataaaaagaaaaggaaaaaaccgaaaaacaaatttttaacatttataaagcggctcattcttgtctgctttcttgtcgggctggccggagtcattgcgggaatcagcacttttgcgtattacgcaagcagctccccgaaactgacgaagaagcagttatccgacccgattccatcggtgattaaggataaaagcaacaaaacagtcgcaacgctcggggcacagaaccggaaatatattgattatgaagagcttccaaaacagatggaaaacgcgattctttcgacagaagatgcacggttctatcagcaccacgggatcgacccgattcggcttgggggtgcggtggtcgcaaactttaccaaagggttcggatccgagggggcgagcaccctcacccagcaggtcgtttccatggcgttaaataataaaaacgaaaaaacattaaagcggaaggcccaggaagcgtggctggcgatccagcttgagcggaaatatacaaagcatgaaatccttgaaatgtatgtcaataaagtctatatgtcagacggtgtcttcggctttgagacagccgctgaacattattatggcaaatctttaagcaaattatcactgccggaaattgccgtactggccggcatgccacaaagcccgaataattataatccgtttgaccatccggatctgacgaagaaaagaagggacattgtcctttcgatgatgtacaaaaacaataaaattacaaaggcagaaatggaaaaagcgcaggccaccccggtttcggccggactggtcaaagaaaaagagcggaatacaaacgcgaacaaatatcctgcctttgtcaatgaagtcattaaggaagtgcagaaactcgggaactataatgtgtatgccgatggtttaaccatttatacaaccctggattcttccgcacagcaatatacggaaaaaatcttaaacaccaattcgatcatcaattatccggataaaaaaatgcaggccggcattgccctgatcgatacgaaaacaggcgaaatccgtgcgctcggcggcgggcgcaatatgaaacttgaccgtggcttcaactatgccgttgatacgaagcgttcgccgggatcaacgatcaaaccgattcttgactacgggccggcgattgagtacttgcactggtcaaccgggcaccaattgaacgatgtggcaaccacttattcggacggaacgccgattaatgactgggataaccggttccttggcaagatgagcatgcgcaaggcactgtatttatcacggaatattcctgcctatgaaacgtataaagaagtcggcaaggaaagggccatccgttttgcaaaaaaactcggccttgatttaaacagcaaagaaatcgttgaatcttcatccatcggcggaggggtgcaagtttcaccgctgcagatggcttccgcttacgccgcattcggcaatgaaggcatatacaacaagccgcatgccatccggaaaattgtcctgcgtgacggggtcacggaaatcaaaccgcatgtccagtccaaaatcgccatgagtgattttacggcttatatgattacggacgtgctgaaagatgtgctgacaaaaggcaccgggacaaccgcccatattccaggattgcctgccgccggtaaaacgggcacaacgaattttgataaagatgagctggcaaaatacgggattttgagttcttctgtgcgggattcctggtttgcgggctacacgacaagatattcgttagctgtatggaccggatacgaaagcgagaaaggcaaaaaatatggcgtcacaaggccgtatcaaacggtcgcgcagcaaatttaccgccacttgatgcgctatgtatcggaaggcaaagaaacgcctgactttacgatgccgaaaagtgtcgtcagaatgggaagcgaattgtatatccgcggccatatcgatacagcgattgataaaaaatccgttacccaggatgcgccggcaaatgttcacgcagcgtatgatgcaaacagcaaaaaaattacggttacctgggattatgaaggatcaggtgcaacctttaacgtctccggcacaataaacggcagcgcggcgtcattcggttcgacttcaggaaaatcgatcaccgttgccaatccgaaagcgggcgcaacgtatgtcttcaatgtcaccgccacggtaaatggcgtgaaaagcaaagcggcatccgccagtgtaacggttccgggggatagcacggacacgaaggcggatgataaccaaaacaagcaaccggaagacaatacccaaaaacaaccggatgcaaacaattcaaatacgaatagcaataccggcactgacaccaatcagtccggcgaaaacaaagacaacaccggctcagacaagggaacaaacagcggcaattcaaacggcaccggctcggaaaacagcggaaacggcaacagcaacaaagataacaacaacggtccaggaaacagttcaggcactggcccttcaagcggaaatgacagaccggcaaacaatggagcaggcactcatggcaagggaaacagcggttcaaacggaaaccaagggaccaatacgaacggcgggaacagttccaataaaggcgaaaacagttcgggcaacacgtccgcaaataacaataccggttctgaataaaaaagcacgtgattgatggcttcctgtgctcccgccggttcgcaccaaaaaagcatggagaatcagttctccatgctttttgtattgttatttcttgttctctttctgcttcatccgtttcttcccttccctgcacaggtcaagaagcgggcagatttcacattgcgggcgctgggccttacaatggtagcggccgaagaagatcatccggtggtgcgtgatcgaccattcttctttcggcacttttttcattaaggtttgttccacttccaatacactgtctttgtagcggcaaaaaccgagccgtttgcttactctctccacatgggtatcgacagcaatggccggaatgccaaaagcaaccgacaggacaacgtttgccgtttttctgccgacgccgggcagtttcattagttcttcacgtgtttgcggcacttcccgcccgtattcctcgatgagcatccgacaaagtttttggatgttttttgctttgttgcggtataggccgatcgaccggatgtcctgctgcagttcttcaagcggcacggcaatataatcatccggcgttttatacttttgaaacagattttttgtcactttattgacgagcgcatcggtgcactgggcggataatgttaccgcgatcagcagctcaaaaggatttgaatgattcaattcacagcgggcatccggaaacatttcccccattgtctcaaggcaatgccggatttgtttttttgtcagcatttcttaaactcctgtaactagtttacataaaattattattgtcacctttattgttcgagccagttataaaacggcaccggattggtcgttttcggtttttctgtttgcggttttgacgatttacggaaattccttccatattcacgtgcttcatccaccgtccggatgccgttctttttccattcaaacaaaatgcggtctatgtagcggaaattcagtttgccggagatgacggcttcgcgcagggcggctttgatcagatcaggggattgcccgtcctggtcaatccacatcgccaatgtttcgcattcgagcggcgacagcggcctgccaaactcctgttcaaacgtggtgtataaatcggtttcttcgtttacgcttttttcaagctcgtcctgttttttctcatagataaattcatcggcgagtttcgcccacagcggcatgatcgaatatttttcatacaggatgccaccttccccttccccttcttcaatggacaaaaactgatgctggattagacgccgcaaaatcgaaacgcacatactttccgaaatggtaagcctgcctgccagatcttcaggcgtcggaaacgcatttccctcttttaaaaaagaataaacttgcagcaaaagcacaagttccgtttcattcaggccaagctgtttgtattttttcaataagagctgggggacggtcaatatcccttcttcccaccaggcaagcaaaagatctttatccatgtcggacacctcaatgtaagtatagcagtttaaaaacggcaagggaattgaaaaaaacatctgaaaagaaaaacggctgcacaccgtcaatgcagccgttttttcaattacggatagatccggtttaaaagcctcgggaacggaatcgtttcgcgcacatgctcaacgcccgaaatccaggcaaccgtccgctcaaggcccagcccgaagccggaatgcggaacagaaccgtattttcgtaaatcaagataccatttgtaagcttcttccgacagattgaaatccttgatccgtttcagcaacaaatcatagtcattgatccgctcgctgccgccgatgatttccccgtacccttccggcgcaatcaaatcggcgcacagcacgacttccgggcgcttagcatccggctgcatgtaaaacggtttgattgcagccggataatgcgtaatgaacaccggcttgtcgaaactttcggcaatcgcggtttcatgcggcgcaccaaaatcttcgccccacgtgatatcatcaaatcctttttcatggagcaattcaatggcgtcatcatacgtaatccgcggaaacggcgccgacacttgttcaagctttgaagtatcgcggccaagccggtgcaggtcgagtttgcagttttccaaaacggaccggacgatataagagacatactgttcctgcactttcaggctgtcttcatgttcataaaaagccatttccggctcgatcatccaaaactcaatcaaatggcggcgcgttttcgatttttcggcgcggaacgtcgggccaaaagagaatactttcccgaatgccattgctgccgcttccatgtaaagctgcccactttgtgatagataggcctcttcgtcaaagtacttcgtatggaacagctcggtcgttccttccggcgcactgccggttagaatcggcgggtcgattttcgtaaacccgtgcgtattgaaaaactcatacgtcgcccggatgatttcgttccggattttcatgacggcgtgctggcggcgggaacggagccaaagatgcctgtggtccattaaaaattcggtcccgtgcgcttttggtgtgatcgggtaatctacggcttcatgaatgatctgaatgccggtcacctggagctcgtagccgaacggggagcgggcatcttcccggactgtcccggtaacgtaaaaagaagtttcctggctcatcgatttcgccgtttgaaagacctcttccccggcttcgttctttacgacaaccccctggataaagcctgtcccgtcacgcagctcgagaaaagcaattttgccgcttgaacgtttgttgttcagccagaccccgatcgtcacttcctccccgatatgctggtgtacttctgaaatggtgattttcacggtatttccctccaaaacaatttccggcttgtctcccatatgtaccgaaatccattatactaaacaaaggcggaaaaaggaaacaagccaaagtttcacgcttttttccgtgtttccacgaactgtttgatccgcttgagcgcttcttcgagattttccaaagaagtggcataagaaagccggatattgttttccgcgccgaaaccggaacccgggacaacggcaacgcgcgcttcctcgagcaaagcctccacaaatgcgtcaaccgtttgaaacccagtcagctttgcggcttctttcacattcgggaataaataaaaagcgccttgcggtttgatgcaggtaatcccgtcaatttcaatcagctggttaaaaacagcattgagccgtgcctcaaaagcctggcgcatctcttccacggtgcgttcatccccgctatatgcggcgagtgccgcgaactgggaaggcgttgccggattggaagtcgaatggctggcaagatttgtcatcgctttgatgatatccccgtttccggccgcatagccgatccgccagccggtcatggaatgggattttgagacgccgttaatgatcaccgtctgtgctttcagttccggtgaaatggtggcgatcgagacatgccggctgccgccgtacaccaatttttcgtaaatttcgtccgacacgatcaaaatatcgtgtttcaggcagacttcgccgagtttttcaagttcttcccttgtatacatcatgccggtcggattgccgggagagttgagtacaaacgcttttgtccgcggcgatacggccgcttccagctgctccggcgttattttatactggttttcttctttgccttctacaaagaccgggacgccttccgcaagctttacctgctcgggatagcttacccagtaaggagacgggatgatcacttcatcgccctggtcgagcagcacctgaaacaatgtatacaaggcgtgttttgccccgttggtaatgatgatttcatttgctttaaagccaagcccctggtctttttggaatttttcaatgacggcctctttcagcgatgccattccgccagccggggtatacttcgtctggccgtccagcatcgactgatacgcggcttcgataatctccctcggtgtattaaaatcgggttcacctgcgccaaggccgatcacatcgatgccttgcgccttcattgcttttgcctttgccgtaatcgccaacgtggatgacggcgttaatgcacttacccttgatgccagtttcatacgattcacctctccaaacggatcaattggatttttttaaaaaaggaacctcatcatagccgaggctgtttccttttatataagcaacttcccaaatgggaacctggctttccatgccgagccgcacagataaaattttatccggctgccttttctgcaccacttgtttcactgcatcctgttttgagatgccggtattcaagtctaggacggtcacacgtttcggtttcttttcagggatccaaatcgcttttttcttcccgccttttcctttccccacgacaacataataggtgcttttgccattgtaaagataaaatgcatcggcagcccggatgccggcttcgcttttggcaacagcgaccgctttgttgtatgcttcatgatacggtttccgtgctttccaataagtctctgccgcaaatccggctatcacgatgaccaaaatgcaaattgagatcagtgcttttttcattccgaaccctcattttccatggcgtaaatccttttaagcagatattgtcattcatatcagttcccatgcaggccatcctaagcttagaatcatttccttcatcattatacagcaaaaatgaatgaaaaaatgatgcatttgatcatttttccggtccaccctgttttgtgctgcattgtcgcagcactttttttacagccagctttcaatgacctcaagcgtctcattcaaatccaggtgcctgatgcggaccggtggcagcgattttgtgaacgccgacccgtatgtagccgtttcaatccgccggtcgaggacaagaaaaatgccgcggtcgtgacgcgtccggataagcctgccaaacccttgtttgaacctgagcacggcttccggcaacgcataagcggaaaacgggtttttcccttttgccctgaaataatcggactttgcttcagtaaccggttcatccgggggcaaaaacggaaggcgggccattacaaggcaggaaaggtcatcgccagggatgtcgaccccttcccaaaagctgcttaaaccgaaaagaatggctttgtcaaatttttgaaagcttttcgttaacctcgaccgactgccgcttgatatgccctgggcgataaacatataatcttcaagcatgccgctttctttcatcagatggtacacgtttttcagcaaatcaaaggatgtaaataaaatcatcatcctgccttttgtggcctccgcaacggcaagcagataacctgccattttttccgcaaagtcttccatgctgacggatccgatatcgggaaggtcgttcgggataataaactgcacctgcctgtcgaaccggaaaggcgacggaatgcggaccgtttttgtgttgtgcgctagccccgtctcgtccagaaaatagcggaagcttccgccaacagtcaatgtcgcggaagtaagcacaacgctcttttttcgcgaaaaaaaagctttttgcaatgtttctccggcaggcaccggctggcaatagatgacaaggctgttcgggagggcgcgcaaatccccttccacccagacgacattttcatccccgccgttttggccggcgaaaatggccaggttgtcgcgcaaaaggcgccaatcttccaaaaagctgtacatttcttcgataaatgcgagtgcctgttctttcatctgtttttcggaaagcaactgcgaaagtctttcttccaaagcctgtgaaatctctttcatggacgccctgatccgttccgtacagagcagaactgcctgccatgctttttgtttccaattttcttttttaattcttaatttgattttctggtaaccatttgtttcccggttcgcgcgcaacactttttgggcgagcatgccgaataaatcatcgagctcggcatcaaggccctgcaggattgcatcgcattcaaacgcgtgcagtctggcttttagcccgtatttttccatcattttttccaacttgtaaaacagttgtttttgctcgtacaggccgagccttgccatcatatattttatttggttgtaacttgcgcgtttcccgatcgtttcccgggccgcttgttcaaggcggtgggcttcatcaatgatgacgtattgaaatccgtcaaacaccgactggtccctttcaagttccgcgcacagcatcgcatggttcgtgatggcgatgtcagcagaggctgcgcaggctttggcgtaaagataaaaatcccgcgatttccacggatcttttttatccgtatgccagccgtcctgtttaatccgctgccaaaaatgttttccgccgccggataaatgaagctcgtcaagatcgccgctttctgttccggtaagccagaccaggatttgcattttggcaaatacggcgtcgtactgccggtccggttcttttaacgactgttcaaacttaaacaaatgaaggtaatggctcctcccctttagcaacacggtcctgaccggggttttcagcatctgttcaagccttttgatttccttatttaaaagctggtgctcaagcgcaaccgtatacgtgctgattaacaccggtttctgttccgaaatcgcttggaaagcggccggcacaagataggcaagggatttgccgatgcccgtgcctgcttccaatgcgacatgctcctcagcagaaaaagcttcccggacatggtccatcatttcaaattgggcggggcgcgcttccaccccggtacctgaagccgcaaaccaggattctttttcaactgcatcctgcgggtaacggccaatctcgcgcggtccgttatccggcgggaggattttccgctttaatgcaatgccacggtatacttccatatccggcggcaaatgctcgatatgccgccgtttctcttccagtatatcctcaaaaatgccggcaaggtcgcttttcaaggaataagaaagcggcacgagttgttcaagtgtgacgacaggaagggacgcacacttttccatgcaggcaagaaacagctttgccgtaacaaaagcatcactgtccgcccggtgcggccgttcatgataaagggacaaagaatcggccagatcccccagtttataactgtttaaagttggaaatgcaattctcgaaaattcaacggtgtcaaggctcggcccgcgaaacggcggaaaccccgcagcctttaattcctgctgcaaaaacggcaggtcaaacagcacattgtgggcgacaaatatgctgtcttccaaaatttccataatgcgcggggcgatctccgaaaatacgggcgcttcttcaagcatgccgttatcgatcccggtcaattccgaaataaacggcggtaccggcttttcgggattaacgaagcttgtaaattgcgtttttatctcccggccttcaaccacaacagcggaaaactggatgatgcgatcgcctttttttgctgaatttcctgttgtttcaagatctacgactacatagcgctgcataacatcacctgactaaaaataattgccccgtttcttccatattgtactattttaacataaaatcgatcattcgccacaagcagatgcagaaattaaaaaaccgccctgccggaaaaagcaggtgcggttttacccttacaaaatcgtggaagccggttcttccgataacattttttcaatccggttttttgcatcaagcaggacaattttcggatggtggtttttcatttcttcttccgtcaaaagggcgtacgaaatgataatcacaatatcgccgggttgtgcaagccgggcggccgcgccgttcaggcagatgacaccggatcccctttcacccgggataatgtacgtttcaaatcgcgccccgttgtaattgttcactatttgcactttctcattgggcgccattcccgcagcatccagcaaatccgcatcaatcgtgatgcttccgacatagtttaaattcgcttccgttacggttgcccggtggatttttccgttcatcacagtccgcagcaaagcaatctctcctattctcatgttgtttattctgtaaaaatgatattatcgataagccgcgcttttttaaattggacggcgattgcgaggatacagcgcccgtggacgacttggaccggttcgagttccggataggcatacaattccacgtaatcgattttcccggacagatgcgcagaaagatgcgttttcacaagggaaaccaatttttccgggtttctctctccctgttcaaccgctttgtttgccaattgcaaacttttgtatatttcgggtgcttctttccgctccgcctccgataaatagacgtttctcgaactttttgcaaggccgtccggttcgcgcacgatcgggcacgggacaatgtcaatcggaaaatccaaatcgcgaaccaaattttcgacaacggccacctgctgggcatctttcagcccgaaataagcgcggtccggctgaatgaggtgaaacaatttcgaaaggactgtcgccacgccgtcaaaatggcccggccgctttcttccgcaaaggacatccgtcccttttgtcactgtcatttgaaccgataaagcgcgcggatacatttctttaacagacgggataaacaatacatcaacgccggctgcttccgctttatgccggtccccttccgcatcgcgcgggtaccggtcgaaatcttcattcggcccgaattggagcgggtttacaaaaatactcatgatgacaatatcgttttcttttcttgcctgctttgccagggcgagatggccttcatgcaagtagcccatcgtcgggacaaacccgatcgacttgccttcttttttataccgggatacaagcgtccggattttctgcttcgtttctacaacactcattacctgcacggttttcattttgcatgccccccgtacagtgttgcaagttcttcttctttcatcgtgtacgtatgcttttcttcggggaacgtccggttttttacttcctgtacgtattggtggagcccctctcgcatcacggcatccgcatcggcaaattgcttcacaaatttcgctactttttcgcttccgtatttcaccaggtcgtggaaaacaagtacctgcccgtctacgccaagcccggccccgattccgatggttggaatggaaagtgcggctgtcacttcttccgaaatctgccgcgggacgcattccaggacgacggcaaaagcgccggcctcctcgcacgctttcgcatcttccagcagttttttggcggcttccgctgttttcccttggactttgtagccgccgaaaattccaactttttgcggcgtcagcccgatatgtgccattaccgggatacccgattccgtaagcgcttcaatttgagccgcgacttctttcccgccctccagttttacggcatgggcaccgccgtcctgaatgatgcgggcgccgttttttaatgtttcttcacggctcaaatgatacgacataaacggcaaatcggtgacgataaaagtgtttttcgccccgcgtttaaccgcttttgtatggtggatcatgtccgctacggtcaccggaatggtcgaatcatagccgaggacgaccatgccgagcgaatcaccgacaagaatcatgtcgacgccggcttcttctgcaagctttgcagaagggtaatcgtaggcggtcaccattgcaattttttcttcttgcgtcttcatcttcacaaaatccgtcgtttgtttcatttttcaacactcctcacctgtcatggattgaccggtgcagaggaaacaaacaattggaaaaaggagcccgtcactggacagacgggctccctgttttttcatcaattgttcattttggccctctgtccccgtccgtttaaggatcaaggcagaatctattttgtataaaaagctgaaatggtatagttccgaaatagatactacccaagttgattataacaggaatggccgaattgcgctatatccggccaaaaaatttgtcaatttttttaactttcgatttcaatatctgcggagtaaatggcatgcatctgtccgtcttccccttcaagctggagcacaccgtcatccgtaatgccgatcgcacgccctgagatatctccttttaacgtatgcgccgtgatttttttccctgccacattggcatagctttcccataaaattttaagcggcgcaaaaccgttttgcagataaatttcctcgtatttttccaatttctcaaggatgcgctgaatgagcagcgcgcgttttacttttttgccagaagcaagggaaagggatgttgcgatcgattttaagggggccgggaaatcggtttcgtttacattgatcccaatccctgtgatcaccgcctgaatccagtccgtgtccgcttcaagctctgtcaggatccctgcgcatttttttccgccgattaacaggtcattcggccatttgatctccggcacaatccccgccgtttcttcgattgcctgtgcgaccgcaacggcggcaatgagcgtaaacgggggtgccatttgcggcggaagatccggccgcaggacaatgctcatccaaatcccggtatatttaggggaataccaggaccgcctgagcctgccccttcctcccgtctgctgctctgcaatcacaagcgtgccatcaggacagccttcctggacaagctggtgcgcgagccgctgggtagaatcgatcgtttcccggtaatgaatatttcttccaagccgtttggtcccgagcccatacctaatttcattttccgtcactttatcgcccgttcctttaatccggtagccttttttccggaccgcttccaattcaaaaccttctttgcgcagctcttccatatgcttccaaaccgccgcccgcgagcagtttagttttttcgccagcgtttctcctgatacaaagccgtcccctgcttccgtcagcaattctattattttttctcttgtggatatttgcacaaaacccacctccggattgcctcatattggttttcgatttcgccgtttatcagcgctttttcaatctcacgaagcatttctttcagccatggaccgccttttttcgaaaaaagcgccatcagctttttcccgtcgattgctagctcgctgcggtttttcaccggtaatttccggaaagactgccggagggcggaaatgcggggcgccgggttttcgcggcgaaaagcacagaaaaccgcttcagcatccaatgccgtttgttcaccggcatcgtagagcatcagcggatcccactttcgctcggcgcgcatcctgaaaaagccgagcgtacgtacgatggctttccgtttttcattcggcagtttccattttcgcaaaaaagcattggcatcttccgggttcgcggcggcaacaaggtacacccaaagctgctgttctgacaattcgtttaacaacgggtgcagggcggaaaaaagttgcgcttccctgccgcaaagaccggggagaaacccgagaagctcggtttcttgaagcagttgaagcgcttcattcggatgctctccttccagcaatttgataaattcctgggttatccgctcaacagcaatatgccggataagcggtgcatggcgcttgatggcctgtttcgttccgtcttcaatcccaaaaccgagctggctcgtaaaccgggcggcccgcatcatccggagtgcgtcttcccggaatctttcttcaggggacccgaccgtttcaatccgcttcatccggatggcttcactgcctctaaacggatcaatcagtttcccgtttttatccatcgccatcgcattcatcgtgaagtcgcgccgttttaaatcttcaagcaatgagtccacatattcaaccgattccgggcgccggtaatctttataggccgactcggtccggaacgtcgtgatctcgtactggtttcctttatataatacaagcactgttccatgttcaatgccgatgtcaacagtatgtttaaaaagcgcctttacctcttccggttttgccgaggtggcaatatcgacatcgtgcaccggccgcccgagcaggctatcgcggatcgagcccccgacaaaaaaagcttggaaccctgcgtcttcaagcgtccggataatgggaagcgccgtctgaaatggcgggagcatgtccatcaacctcatttaccgtttgttcatatatttgttcgtattgtttcaaaatgttgcgggaataaaatttctcttttaccgtcttttcgcacgctttcgaaaatgcagcataaaggcctggatcctcaagcagccggacggcttttcgggcaacgtcgctcacatcacccaacgcgcacaaatagccgttcaccccgtctgtgatgacttccggaatgccgccaacccgggtgccaatgcacgggacaccgcacgccatcgcttcaagcgcaacaaggccgaaactttccttttccgataaaagcagcatcaggtcgctgattgcgtacagctcctcgagccggtcctgctttcctaaaaacaagacatctttttctataccgaattgggcaacgagccgggagacgacggtcatttccggcccgtcgccgacaagaagcagtttcgccggcatttgtgcccgcactttcgcaaaagccttgacgacatcgggcacgcgctttaccgcccggaaattggaaacgtgaatcagcactttttccttttccgaaatgccgtaatcctgttttaaatggcctgcctcccttttccggtatacgcgttcatcgacaaaattataaaccgtcgaaatgtttttctgcggccagatcaaatcgtacgtttgccggacgagcgcttcagaaacggccgttactgcatccgactgttcaatcccgaaccggatggcggaaacaagcgacgggtcatacccgagcacagtgatgtccgtgccatgcagggtggtcacgattttcatccgggtgccggccatcattttgccgagaatggcgcagatggcgtgtggaattgcataatggacatggagcacatccagcttttccctttccgccacttctgcgatcttagaggcaagcgcaatatcataaggcggatattgaaagacggcgtactggttcacttccacctgatgggtataaatattcgggtacattttattgagccgaaacgggacactcgaggtaataaaatggatctcgtggccgttttcggcaagcagctggccgagttccgttgcaatgacgccggatccgcctacggtcggatagcacgtaatcccgatttttaactttttcataagtcgagcacatccaaattcacaagaaccggttttttgcttaaaaacccttctgcatatttcaccccgagctctttcccgaacatcctctcacgcgcggtgaccgcttcaatatagccatccgtaagcggtgtatggacacttctttcccgtatcgaaaactggctttcataggcatggaggctctcaagttttttgtccataaaattggtgacatcgacgacaaaatcgggcggatgaaaaccgtttaccatataaaaataaagatgtttcggtttatgggaaggaagatccggttcagaacggtatttcccgataccggccgaaaaaaaggcttcctctgtaagcctgccgcagttaccgtgatcgggatggcggtcttcatgaaaaggcgcaaacacgacatccggctgaaacttccggatgacaccggtaacggcgcggatagcgtccgcttgcataaaaaggccgcggtccggcaatttcagcgttaccctttctctaaccccgaggcaggctgccgatttttgcgcctcttttttgcggttttcaaccgtcccgttcgaagacagctccgcttctgtcaaatcgcatatcgcaatttttttccccattgatgcccatttggcaatagatgccgccatgccgatttcgacatcgtcggcatgggccccgaaagcgagaatatccaccttgccggccatttcctttcctccttccggttaatccaaaatattttcgagcccataaacaaatgtattgaggttcatcaccgtttcaacggctactttcacccctgacatgaaagaggcgcgatccatcgagtcatggcggatcgtaagcagctggccgtccccgccgaacagcacttcctggtgggcgacaaggccgggcaggcggacgctgtggatatgcatgccttcaaaatccgcgcctcttgcaccttgtaatgtttctttttcatccggatgcccctgtgttttttttcttcttgcttccgagatcatttgcgccgtttttacgctcgtgccggacggggcatcttttttccggtcatggtgtagctcgatgatttccacatccgggaaatatttcgccgccatttgcgcaaatttcatcatcagcactgccccgattgcaaaatttggtgcaatgatacagccgattcctttttgtgcggaaacggcctttagttcttccagttccgcatcggtaaacccggtcgtcccgacaaccgggcggacaccatgtgcaagggccgttttcgcatggaggaaccctgctttcggcaccgtcaaatcaatccatacatccgccgggcaattttcaaggcatgcttccgggtcggtatacacccggaccggttcgccgttataatcggatacatcattgaacagtttgccatcaaaagtcctgtccactacgccaacgagtttaaaatgttccgtccgctcgatcagccggaccgcctcgctccccattttcccgcgggccccggcaacaataatccgaatatcatccatgtttcattactcctcctgctcttttcgcgtccatctgtctttatcacgcgtgttaaatttctgcaaaaccattgtatgggcttcctgtaaatcaatatgtaaagcatttgccatgcaaatgacgacaaacagcaaatcgccgagctcttctgctacggttttcggcttctcatccggttttttcggtttttccccgtaataatgattgatttcgcgcgccagctccccaagttcttccgtcagccttgctgtaagcgcaagcggactgaagtacccttcttcaaactggctgatataatcatcgacttctttttgcatttgccggatcgatttgttttctgccattttcatcccccaatcctgtaatcctcttccatgttagccaaaaacggcagattttacaaatcatatatttgcttttctctctgcctgattgcccttttgtaccgctttcgctataatgggaacgccggatatataccggggaaggaggatacggattatgctgaaaatgaaaaacatcttttttatcctgctcggctcttgcatctttgcctttggcattgtccattttaatattcagaaccatctggcggaaggcggttttaccggaattacgctgctgctttactatttatttcatatcaacccctcttactccaatctgattttgaatattcccgtattttttgtgggatggaagctacttggaaaaaaatcgttttactatacactggtcgggacggtcggctcctctctttttttatggatttttgagaagaaacatttccatattccgcttcgcgatgatatgtttcttgcggcgctgtttgccggggtatttatcggcgtcggtctcggcattatcttccgctacggggggacatctggaggcgtcgatatcattgccaggctcgtgtttaaatataaaggcgtggcgatgggcaggaccatgttcatgttcgacgcatgcgtgattacgctgtcgcttatcacctatctgcattaccgtgaagcgatgtacacgctcgttgccgtttttgtcggctcgcgtgttgtcgattttctgcaggaaggggcctatacggcaagaggcgcttttatcatttcggacaagcatgatgaaattgccgagaaaattatgaagcagatggaccgcggcgttacggtttttcgcgggcacggtatgttcacgaaacaggaccgggatgtgctgtactgtgtcgtcggaaaacatgaggtgtcccgtttaaaaggcattatccattccgttgacccccatgcctttgtgtcgatgatggaggtccatgatgtgctcggggaaggctttacactcgatgagaacaaacagccgattgaagattaaaaaagagctgccgcggcagctcttttttaaatctgtttttcaaaatgcaggcgtttgttgatcaggtagatgaccggcataccaatcagcatcacagcaagttcaccgatccctgccgtcagccagccgaaaaagaaaggcacgccgttaaaccattgcatttcccatgcgataataaacatggaggccgtaaaagcaatggaattaaggatcatctgcccccagacgccctttataaaccgtgcggataaaatggtaatcgcaagcgcaaggacggactgacccgtgccgatgaacatatcatacttgatcggcgagaaaaacaagtttgagagaaaaacgcctaatacaatgccaatcatatacttcttgttaaacacaacgagatggttaaaaatttcagaaacacggaactggatgttcataaacgcaagcggctgaataaaaaatgtcaccgcaatatacagcgccgcgacaatcccgttgacgacgagtgttttcagtttcatatgcatctctccttagtttttttacgtgggatggtttcgaaccacgggttggaaacaaccaaacttcttcattataatgcaaactagaacatgcagcaagacaaaaaaagctttccgggttgccgattcaccccggaaagcttttcgtactgttaattattgttgttattgccgtttaagttggtaaagatgaggattaaacgcagcagttcaatgaccgcaacagccgcggcagccacatatgtgagcgcggcagccgataacactttgcgcgcttccctttcttccccgccgcggacaatgccgagcgatgtgacttgtgcaagcgcacgggacgatgcattgaattcaaccggcaatgtcacaagctgaaacaacacggcaagccccatgagaatgatcccgagcaggaacatgcctgtcgcatgcgtgaacatcccgatcaaaataaaaatccaagaggcattgctgccgatattcgccacaggcacgaggcggtgacggaaacggagcggcccgtaattgactttatcctgaatggcgtgtccgcattcgtgcgccgcaacagcagcccccgcaatcgaacgcccgtggtagttggcagtcgacaaattgaccgttttgttaatcggattgtaatggtcgcttagaaagccgctgtgttccagcactttcacatggtataagccattttcgtccaagatcatccttgccacctcggcgcctgtcatgccggatgcatttgcgaccttttcatacttgctgtatgtgttttttaccttcagctgggcccagatcggaatgattgccaaaatgagatagtaaatcaaaaacgacatttgccaccctccataccctccatggtaatcttacctttattgtatccgaataaggtcaaaaggtcaatccatatgatcggtctcgtgacgctcttctttttgccctttgtattttctccatccgacatacgataaagtaagaatgatgatgctgccggtggaaatcataatccaccagagggaggggtcggcttcatcttccttcatggcttcaaacagctgcttcaaatctgtccggagcgcctccagttccttttttccggacccgctgcctgccaccttgtcccgataacgatcaatataagcgattttcgaatcgagccgctgtattttttcaaccggcagatccactcttaaactcggctcgatcactgcatattgtttgaggaacaggtttaatttttcgttgtacgtttcgcgcttccctgttgcggctgctttttgcacctctgtaaatgaagacatcaccggcccttccatctgcgtccagagcggctgatacttcgattggatcgcatccaccacgagccggaatgacgtgcaggcatccactttctcctcaggctctgcgcttactttcgtcaacgcctttaccgcttcatcatgggtgacggtcaaaactctcaattcatccatcgttaaacgtttatttttaaacgattgcctggaaaatgttttcgaaaattcattcagcacattttttgcttctgcatattgcccgtttttcgccagctgcaatgcctcgtcgcttaggtcatttaaatgtgccaaagcatcatccgaaccttttgcaaaactttttccggcaaaacttaacatgaacacacaaagaaggatcactacttttctcctcatccttgtcccccctcatactgttactaacttatgaagggagggacaagagtagaccataaaaacagcccggcgtccatttcggggattcctgctttctgccgacggaaaaagcgatttaaagttcgaggcggagccgccttttgtgcacggcaaaccggtatgcaagcaaaagagaaaggatgctcagccaaaaggtaaaatagccgatttcacggatataccggtatacatcttcgtaccggggaaactgcataaaaacgtagtcaataatatcattgtgcaaagtccataccgccgcaaccaaaagatgcttccatttgaattggtaaaacggcgcatacaatattccctctatcgccattgccaaatgggaagccatcagcatatatccctgccatggcaatgagccgtttacgatcagtacgagaaggttcatcgcaaccgcccaaatcccgtatttaaaaagcgtcaccattgcaagtgcctccacatacggccagtgtttccgccataaaaaggcaagcagcacaaacagaaagaacaggcttgcggtcgggctgtccgggacaaacagccaaaacgcaggcggcgtatcgcgaagctgccacccgtaccaaatgtaaccataaatggtccctgcagcattggctaaaaaaagcatccaaaggacacgcctgtctgccagcgccgcatacaatgccggtacattcatcgtcttcccccatttcaaaaaagatagattcattttaacaaaacagaaagcacgaaaaaagccggcttctgccggctttttttgcttttatttcgattttagcccggcgatataatccgccagttttttcaaatcctgatccgagcctttaaattggttaggcggcattttccccttgccttttttggcgatttttgcgatttcatccgcacttaagcctgtgccgactaaagaaggggctgccgcactgccctggagattttctccgtggcacgtcacacacgtctgcttggcaaatattttatagccttctgcgtttttgtcaatggcaacctgtttcacgattttcccctgctctttcgcttttttccaatcgtggtgggccgccgcttcccatgtcaggtagaatattgcacaaaccgcgagcagcataaacccggttgcaaggggcctatcaagcggccgccgcttagggccgcggtcaataaacggtgccaacagcagtgcaagaaaagcaacgcccgggatcgcgagcccgatcacctggtacgggccggaagaataagtatactttaatagttcatacaggaatagaaaataccagtccggcatcggaatataactcgtatccgtcgggtccgcaattcgttcaagcggcgacgggtgtgcggcagtgagacataaaaagccgacgagaaaaacagcgccgacgagccactctttcagcaaaaagttcggccaaaaagcttccgttttaccgggatactccgagtaatccttaggaatattcggtttgcggtccgcattaattctggaatcaccaacaaatctcattccttttccgcgatgcatccttccccctccttttgcccgttatggatacttattcattacagcggtccggaaattccctgcttgcggatcatcaaaaaatgggctgccaaaagcagcatcagcaccgctggcaggaaaaagacatggatggcaaaaaatctcgtcagcgtctgggcaccgacaatatccggatggccggccaaaagcgttttaatatacggcccgataaacggcaccgaatccgcaatctgcaggctgacttttgtcgcaaaaagcgctttcatatcccacggaagcaaataaccggtgaggccgagcccgagcatgacgaaaaagatgagcacgccgacaatccagttcagctcgcgcggcttcttgtatgcgccctggaaaaacacccgcagcgtatgtaaaaacatcatgacgatgacgaggcttgccccccagtggtgcattcctctcacaatctggccgtatgccacatcatgctgcaaataatagacagagtgccaggcatttttaatatccggaacatagtacatcgttaaaaacatacccgacagaatctggatggctgttataaaaaaagtgagccccccaaaacaatagacaaaagcggaaaaatggtgcgccgggttgacatgctccggcacttcatggtcagcaatatcccgccaaagcggcgtaatatcaaggcgctcgtcgacccagtcatacaatttgctaagcatctcttccccctcacttcacatatggatttttctgcggtttgcccaggtacagatagccgccctttgttttgacagggtatgcatccaaaggcgcggaaggtggtgttcccggtatgtttttcccgtttttctcataccgtccgccgtggcaggggcaaaaaaactgattcggatgcgctttgttcgtattccagttcacggtacagccaagatgtttgcaaaccggtgaaagcgccacaatatcgcctttactgtctttatacacccaggccgtctgggtgacatccgacttataccagccgtccgtctgttcgtatttaaaatcgacacgcaccggttcgctcttaatatcagaaactttcaatttggttggatgaaagtcgccggctgcttccgcctcgagcaccgggtcgacggcaaaacggagcatcggcatcagcgcacccgcagccataaatccgcctacgcccatcagcgtgtaatttaaaaactgcctccttgacaccggatcttttttgctcaacctgttcccccccttacagaactgttggtttcctaatattttcaagatgtagcaaatacactcttatgataaaacaaagatatttgccggtcaatgaatattgtctattttatgtcaagtatctttctactcgaaataaactgatattttaatataactttttcagttttctccccatgaccggacaataatggagataagctgttttacctgttcatctacaatggcatcctgctgtttttgttccatatgttcaagtgggacagccggtagccagaccacatttccgttcagttcggcctgaagcctttgccagccgggatcgctggtcaaataaaaaatatgccggaacccgctttcagtcaattcggcttcccatgacttgatggcaggccccgcactgtccgggatcgtctgctgcaaataagggaaagcgggcagcaaaacaatccggcctttaaattgcgactcgaggcagcctgcgatcatctggatccattcatatccggaagcgagctgtcggatatggtctccgaatgaaaccgggacaagcggcaggactgccgtgtcaataaagtaacgttcctgttgatacaattccatgtcttttgcacgccagcgcacagatgatacccctttcattttccccgcgggcaaaaaccggaaagattaatcatccagttttttcatctccccgcttaattcgacaaaacggccgtaatctttctcatcgagcgctttgtcgatttcttcccgcagtttattccgtttaaagtctttcatgcttttttccaataatttttccgccatttgccggtctgtctcgtttatatggagatctttcggcatatacgggttttcttcaagcacagccgcatactggtacgataaatgggattttttgaaattgagctggatataaatgtcttcctcacggttcagccggatatcatggaaagacttttccgcatccgttgtcataatattatctttataaaagcggaacggcacattgtccacgcaatgcgtcgacatgataatgccgcgcgggcaaagatgcgcttcctcgacgaaatggactttttccatcagctggtcgtggctcattaaataattcaaaatccagactgactcccgtctttttaattggtaatgatttaaaaaccaacggataaactcctttttctcgttgattgaaacaggggtgagagccatcgtaatccctcctctgcaaattgaatggccgtgtttacagcgggcagcttttttgataaaacattggtttacaccttcattataccttttcccgtctaaaccgcctacgaaaaagtccggcaacgatggccgcaattaatttccgtcttcaagcctttcaagaagtgcaatccattcatcatttgccggatcttcgcgcaaaagcttttggaaaatgccgtaagcctctttccttctcccttcttcaatcaggaaataaccgtaatcctccagaaacaccgtgtcgttttgtaaatcattatatgcatatccataatactttaatgcctgagaatattcttccaaatgcttaagcgatatggccagatcccagtaaagccgagggtcggtatccccttctttttccatgctgagggcccggtcacggacttcttcgtaccgctccttttgaagcagcagctcgttgtaggaaagggccgcatccaaatagccgggatccagttccagcgcttttttaaaataattttccgctttttcctcatcgcctgcttttgtagccatttttccagcaaaatgataaagttctttatcatactcgtcttcttttatgcccttttcagcagcagcaagcgcttcttccggcatttgttcgtgctcatatgcacggccaagatacaggtaaagcggatggtagccgggatccgtttcccgcaattcttcaaacagctctatcgctttttcataaaatcctgcctggtacgcggttaaggcatatccaaataatgtgttcgcctcaaagcggccttccatcgcatgctcatattggtgcaaggcctcttcaaacgcgcccgctgcgctcagcacttctgcaaggcgcccgtggatgtttgtatccgcaaatgtatcgatccctttgcccaaaagccactcatattcacgggaagcttccgcatatcgggcacaggaagcgtagaactcggcaagcgcaaaatggatgacaggttcttccggcaaaagcgatgcagcttccatcagtttgttttcgctgacctcatacaggccctgcatttgatacaaatccgcaagcaaaagcagtgcacgcgggtaatcggggtccgtctccggaatgcggtcgaggtataatatggcttcttcttccttgtccatatcaataagcgtttccgccattaagatcacaagctcgccgtcatccggataagacgcaagcaaatctttatataattgctgtgcttcattcagaaaaccgaggccctcaagttgcccggcaagcgcatatttctcttcgtccgtgccgagcgcgagaaaatcttcaaatgtttttttcgcctcctcgagccggccttcttccaaatgatccaacaattgttccattaagctcatgaaaatcttcctttaatctttgatgtgtttccttttgctgaaccttttgcaacgttagccgcgggatttttgcaaagccagaatcttgcaaagccaaaatccccggttgccgctaaaagcgctcccccggtcccctggtaaaatggcaatcgccctttccctggagcccacttgcctgcaggaaaaaccgcgggtggcctttggctaaatcataatgaattttgaaggccagggcaaatcatttgcctttccgggttccctgtttaagtatttctccgccgtgcatgaaaatccctttttttcacagcaaaaataaagcggggcacgggattttgaatttccgcaccccgcttttccacgggcatcatgatcaagctgttctctgttatcctgaaaacaggcgccggctgattttcattcttttgctggtgcctgttttcaataggcgtctaaagccgttacagaacggatttcagatcatcaaaaaactgcgggtatgatacggcgattgcttccgcccctttcaggcagacagcatcctttgccacaagtgatgcaacggcaagcatcatcccgattctatgatccccgtggctttccaccgtcccgcctgaaagccggcaagggccttcaatgatcatgccatccgctgtcgcttcaatatgggcgcccagtttctttaattcccggacaaccgtgtcaatccggtttgtctctttcactttcagttctgcggcatcttttatgaccgtcctgccttccgcctgtgtagcaagaagggcaatgattggaatttcatcaatgaggcgcggaatcagcccgccgccgatttcaacgccttgtaaagcagccggacggatcaccaacgtgcctgtttgctcgccgtcagatggggcatgtgtttcgatcacttccatatccgcgcccatttgctttaaaacgtcaatgatcccggcacgggtcggattgagcccgacatccggcaagacgatttcactcccgggcacgagcgaagcagcagccataaaaaaggcggcggatgagatatcgccgggcacaacgatctccgtgccatggaaaaccgtgccgccccggacggaaatcgttctcccttccgtcctgacctcgccgccaaatgcccggatcattcgttcagtatggtcgcgggtgggctgcggctcatgcacgattgtagtgccgtctgcctgaagaccggctaaaagaagcgcggattttacctgcgcgcttgcaacaggcagccggtattcgattccctgaagcgccccgccccttatagaaagaggggtgaaattgccgcccattcttccgtcaatgtgcgcgcccatttcgcaaagcggttttgtgacgcgctgcattgggcgctttgcaatcgattcgtcgccggcaatgaccgaatggaagggccggccggcaagaagaccgagcatcaggcgggtcgtcgtaccggagtttccggtatcgagcaccgtttccggctccgccaaaccgtcccatccttttccagcaatcaccacccgggtgccatcccgttcgatcggcacgctcatttgctgaaaacaatgaatggtgctcaaacagtcggcgccggggagaaaattttctaccatcgtttttcccctggcgacagcggcaaacataaccgaccggtgggaaatcgatttatcccccggaactttaatcgtaccttttaaccctgtttgcgcgggtgccaatttttccattgcagccaccaccttctattggatatagacttcatgcggggtttctttttttaaaagattcatggctagatcgcggtcgttttccgagcgaaaactgatccggagcacgccgtatatatcttcccgcgcctcaaggatgcggatattcgtaatagagattcctttttccgccagtttattggtaatttgagaaacaacccccgggacatccggaatatcgacaaataaatcgtaaaaagacgggattgcgcccgatccgctgattggaaggcagtcgcggtattgtttcgcttccgcataaaagcggtggagaagctcatacttgttgtctgcaagcgcctttttcacttcctgaagatttttcgcccatctatccaaaagcctgatcaggttttccctgttaccgcaagagatgtccgcccacatttgcgggcttgaggaggcaatccgtgtaatatcacggaaacccccagcagcaagcctttttaaaaggggatattccgcatctgcatctttcacaagatggacaagtgacgctgcgataacatgcggaaaatggctgatgaccgcaaccatttcatcatgcatttccggagaaacggtgatgaaatttgcctttgttcctttcagccactgtttcaattcttccgtccgctgatcttgttcatggaaaggcgtaagcaaataaaaggcattttcaaacagggacaggctggcggccgtaacgccgcttttatgggaaccggccatcggatgcccgccgataaaaacggtgttgttgccggcgagccgctgcgcctttgccatgatgctttctttcgtgctgcccgtatcggtgatgatcacattttccttcaattccatttgcccgagctgcccgatcaatttttccgttacaagcaccggcgtggccaatataattaaatccgcgccacgcacgccgtcttggatcgtttccacgtaatcatccacgaccatcagggcttttgccattttcatttcttccaatttggcatcataccctgtgaccttggcttccggatgttcctttttaatcgctagtgcaatggatcccccgattaacccgagcccgatcacaaacacatttcctttcaaaggtgccacctctttttgtaaaaaggcggccttttgctgtcaaaaggcccgccgttgtcaagttcatttgcggctttccagaaaagccccgatcgccccgagtacgccccggttctgttcttccgacccgatggtcacccggaccgtccccggcatcccgagcgcttccccggagcggacgatatatcccctgccaagcaaaaaccggcaaacttcctcactatcgcattgaaaatcgattaaaataaaatttgcctgcgacgggtaaaatgcaaggctgttgcggcggcaaaacgcataaaagtgttcgagcccctgccggtttttgtcgcggcagctctggataaacgcctggtcctccaacgccgcctgggcagccagctggccaaggacattggtattaaatggcgggcgcaccggctcgagcttttggatgatcgttcgatcggcaatcccgtagccgacgcgtaaaccggccagtccgtaaattttcgaaaatgtccggctgacaatcaaatgatgataccggcggaataagacaagcgcctgttcgtaatcttttgcgaccacgtattcgctgtacgcttcatcgataaaaacgagcacgtcttccggcacgcggtcaagaaaagcggtcaactcctgttcggtcgtatacgtccccgtcggattgttcgggctgcaaatccagacaaccgccgtgttttcatcaatttgcccgagcatcgcctccaggtcatgccgcccgtcttttaagggtacttcacggacttcggcgccctcgatgatggcattatgtttgtattgggaaaatgtcggtgcggccatcaccgtatttttgtctggttcgaggagtgacctggaaacgatttggatcagttcgtccgtcccgtttgtaaaaatcagttcggttggatcaacgccgagatgtgcggccattttctgtctcagttgtaaggcgtgcccgtccggataacgggtaaaagcaggctgaaagtttttcaaagcctcatccactttcggggaatagccgaacggattttcattggatgccagtttcacgattgaatcgagcctgtattgttttttcacttcatcaatggtctttccgggcacatatgcatgcaaatccgtaatttttgttctccatttcatcatctttagcgagagtcccctgcttccatgcaagagcgcaagccagggggtgatcgcattctctcctttcggttcgtgacacgttagcattctcttattttgttaaatccggacgaagcacggctgcacggcgcaaatacacatgttttatgtcctcctgcccaatgtccgtgtcgacatggatcaggatacggatgcagcggacaaggcttccttcaaccggaatttcttgcatattcataatcgggacatacttccagccgctgaattggcgcatgactttcgaaggaaaagccgaacggatatcggctgttgccgagaacaaaagggaagcaacgcggtccggcttgatcccgtttttttcgatcaaggcattcatcagctcagaagtagcagcaaggacttcgctttcgtgatcgcgctcgaccgtagtcgctccgcgtattccgcgtatcatgtatgcaaatcccccttttgctgcagcagaaacagacggctcagccggtctttgtccacttcagccagcaccggtttgccgacagactcaagcaggacgaagtgaatattgccggcaattgtttttttatcgcgtttcatataagcatagatttcgtcaaatgctgcgccagccggaattttccaatcatagccgagcgtttcgatccagctgagaaattgcggcaaatcaaattgaaggccggtctgttccctgctgatcaaaagcgcgtagacgataccggtcatgaccgcttcgccatgggtgattttcccgaacccgccgtgcgcctcaagggcatgcccaagcgtatgcccgaaattcaaaaaggcacgcacacccgtttctttttcatctttgcggacaatatctgcctttactttgatcccttttttcaacaagtccggaagatgcggggataaaagatgcccgccgtccggaatctttgtttgcaattctataaggaactccttatccgaaagaagcgcatgctttacaagttcggcaaatccgcttaacagctgctttttggggagcgtgcgcaggaaatccgtgtcatacagtacaaattccggctggtaaaaagcgccgacgaggtttttcccaagcgggtggttgatcgccactttgccgccgaccgcgctgtcatgggccaaaatggttgtcgggatttgaataaatgcaatgccgcgcatataggttgccgccacaaaaccggcaagatcgccaaccgcgcccccgccaaaggcaagaatgcatgatttccggtctaaatgatgttccacggcaaacgtcaaagcttcttggtagacttcaaacgttttggcatcttccccagctggcacggtcagtacacactgttccgcgctttcctgaagctgtgaaagcagtttgtccaagtgaagcggccggacattttgatctgttatgaccatgcagcgcgtatatttgcggacgagcggacccagctcctggagcgcgccgcttgctatgtataccgggtactgttttgtttctgtatcaatgatgatcgtttccatttaaaacaaccttccgtattctctttgctccgcaaccgtttttttcagcacatccatcctgtcgctgtaaaactgggcagtgatcgcttccgccagctcccaggcgacaacggcctcacagacgacgctcgctgccggcaccgcacagctgtcggaacgttcgatgctcgctgcaaaaggttccttcgtttcgatatcaacgctttgaagcggcttatacaatgtcgggatcggcttcatgacacctcttacgacaatcggcatgccggttgtcataccgccttcaaagccgccgagccggtttgttttgcgcgtatagcccgtttcttccgaccaggcgatttcatcatggacttcgctcccgggccggtgtgccatttcaaagccaagcccgaattccacccctttaaacgcattgatgctgatgatggcgcgcgccagctttgcatccagcttccggtcgtaatgaacataactgccgacaccggccggcatcccggttgcgatcacttcgacaatgccgccgatcgagtcgccgtttttctttgccgtgtcgatggcttccatcattttttgcgccgccccgttatccaaacagcgtaccggtgaaccgtccgctttttcctgcaaggaagcaagggaatcatatgacaccttttccgcgcggacacccccgatttcaagcacatgcgaggccacttcaacgccgagctctttcagcagttttttcgcgacagccccggcggccacacgaacggtggtctcgcgtgcggaagagcgttcgagcacattgcgcaaatccctgtgcccgtatttgatcccgccggcaagatcggcatgccccgggcgcggacgggtcacacgccgtttcacatcgtccgcaccgtctggaaggggctcaatgcccatgatcttattccagtgcacccagtccctgttttcaaccgtgagcgcaaccggcgaaccgagcgtcaatccgtggcgaacgccggcagaaatgattgccctgtccttttctatctgcattctccgtccccggccgtaacctttctgccttctggcaaggtcagtgttaatttcttcagctgtcagcggcatgcccgctggaaggccttcaataatggtggtcagcgccgggccgtgcgactcgcctgctgtcaaatatctcattctgcatcccccttcatcactttaaagcattacatatctattactataccacaatcgctataaatcgaatagatggagcactttatatttttctatagaaaaaggtgtctacaatttcaaatccatacgcagccggattgaaaatctgctccgtgctgccgacaaataatatgccgtttgccgacagcgttttgctgaaattccggtaaacagacactttggcttcttctgtaaaataaatcagcacgttccggcaaataatcagatccgctgccggataagggtcgtgcagcaaattatgttgtttgaacaccaccgcccgcctgatttcgtccgcaattcgatagaacggacctccgctgcttttttgaaaatatttttgtttcatttcgcgcggcacttccaggatggaacgttcggaataaacgccggcttctgctttctgcagggctttttgatcaatatcggtcgccaggatctgaatcttattaagcggtaaatacttggacaagatcatcgccatcgtatacggttcttcgcccgtagaagaagcggcactccagattttcagtttttctcctttttctttcagcagccctggcaaaatgttccgttcgagcacatcccatcttgacttatttctataaaattctgaaacattaatcgtcattctgtccaaaaattcttccagcaaatgttcgtttttgtccaatccgtgaaaaaattcactgaaagatgaaaaacctcttttttcatataatgtcgtcagccttcttttcatttgcgcttctttatacaaagataaatcgatccccgttttctttttgacttgcgcaatgaaccggccgtaatcatccagttctgttttcattatgcaatccccgtatttttattcagatttgttggttcataccgtttattttaacataaaaaaagattggcgcggagaggatcgccaatcttttttgcatgatttaataaatcgaagcatccgccggccgactgtatgagatcagctcatcttcccggaaaaacagggaaatttcacgtttcgcgctttctggtgagtcggaaccgtgaataatgtttttgctgacaatcacgccgtaatcgccgcggatcgtccccggggcggcttcggccggattcgttttgcccatcatttgccgtgcggtagcgatgatgttttcgccttcccaaaccatggcaaagaccggaccggaagtaataaatgccacgagatcattgaaaaaagggcgttctttatgctcagcgtaatgcttttttgcaagttcattcgaaatttgcatcaattttgcccccgcaagccgaaaccctttcttttcaaagcgggaaacgatttcgccgatcagctggcggctgaccccatccggttttaccattaaaaaagtcctttccatcttcatccactccattcgcatttctactatgtaaggcatcttgaccatagaaaatcgtaccatggtggcgggaaaatctcaatatgtttgaagtaagcgcttaaaaaccgggccgccaacgcagggcactgcccggcagccctgctttcttttaaaactttctttttcccatataacgcgccaaatctgccagcatttttttaaaacgggtatccggaagctgctcaagcgtatcgagcgctttctctagatagcagttgctcactgcataagaccgttcgatcgcgccggactgtttaaccagtctgacaacgtcttcaagctccgcttttggcatgtgctcatggacatattccagcttttttctgatttttgggtcttcccttgcaaaaagcaccggaagcgttacattgccctggcgcagatcttcgcctgccggttttccaagctgcttctccgtgccggtaaaatccaggatatcatcaataatttgatagctcatcccgacattgtagccaaaccggtacaattggcggtggatgttttcgtcggcgcccgatgcaatcgctccgagctggcagctggctgcaatcagcaacgccgtttttcgcttgatccgccttaagtaacagcgcaagttttgatgaaagcggtatttatccttaatttgctcaatttcgccgacgcacacatcaacaagtgtatccgccagaatttggtgggcggagagatcctccacttttgtaatatattcaagcgcggttgcgagaatataatcgcctgtatacatggcaatccggttgtcccatttggcttttacggtcggttttccccggcgcaattcggcatcatcaatgacatcatcatgcacaagcgatgccatatggatcaattccagtgcaacagcgacatttttgacacgttcgatttcgtaatctccgaatttcgcgccgagcagcacaaatacggggcggatcctttttcctcccgctttcagcaaactttcagatgcctgctgtatcaaagcagcgtttgatgcgacagcgttggccagctcttgttcaataagctcaatatccgtttttaaaaacgagtacagcatttgtaccttcattccgtctccatccgatcatcatttctctttcaaggcaatatgtgcagctgcggccccgccggcaaacggcttgtacaaaatcctgccaaaacccgcatcggaaaaagcagctgccagttcttccattcccggaaactgcagtgccgattcctgaagccaggaatattcccggtagctttttgcgaaccattgtccgagaagcggcatgatccggcggaaataaaagtaataaagctgcctgtacccgggaatcaccggctgggaggtttccaggcaggccgccatgccgccgggcttcagcaccctatacatttcctgcaaaacctgtttgtagtccgggacattcctgagcccgaacccgaccgtcacataatcaaacgttgcatcttcaaatggcagttccattgcatttccgtaacggagcgcgacattttttaagccgagcgcgtccactttccgcttcccgacttcaagcatgctttcactgaaatcgagacctgtcacactgccggattcgcccactgcctgtgcgagggcaatcgtccagtccgccgtcccgcagcacagatcgagtgcgctgctcccttctcttaccgccattttccgcatcaggtctttccgccaccgcttatgctggctgaagctgatcaccgagttcattctatcgtagttttgcgaaattttttcgaaaacgacgtgtacccgttcttcttttggcatcatggttacccttcctccgcatataatctcgttgcatcgccataccgccccatcagcaggcggatccgctctaaaagcatttcgtttccgcacgacatggccgcagcctgcagcgcacggatgctttctttcaaatacttctcacaaatataaaatagtttccgctttttctcatgcggcagctgctcaaaagggcgcccgtcacccgggtaagccattttgttcaaggcttcaaacaggatggagcgcttcccgttttcagcctgttccttttcccttaacagccggttaaacaaaagcagttcttcgcttaaacggatgagcggctgcgaaccgaaaaactgcataaattttgtaataatcacggattcgatttttttcaaatgcctgacgaacgtttccgcgtcggaatcgtcaaattggtaaagcatcactttatattcatttacggatttgattccttccgccagtatgccgacaagccggacgttgtgcacgcccgcaagcagtttgtagtaaaggctgctgaaataatcccccgctagaacagtaagctggcggtttttttgattttcatttgcattggttactttttcatgggtgtcaagggcaatctggatcagcatggcagtcgcaacaaactgcttcacttcatgttccgtatacggctgccccgcaaggctgcttatcaaaagcaaaatccggtcttcatctatgtatggggcatcaataaactgatttaaatagtcgtgtgccacttcttcttcaatcgcctgtttgattgcggcaatttgctgctccctctggtatgacataaccctttccccgtttcttcgttgatctggcctaaaaataagctgtagtttattatatcacatatgtaaaacggccgttaacaaattgatttcggtttattttttcgcttcgctttgcaaactcccgatgccggtcatgatttgcgcttcaccgcgaatcttgatcatggaagtatgttcggtaaactgtgcgaccagcacttcgccatcatccagcatttccgtatggttcagcttcgtatcggtaccccttgacagcccaatgacgctcaccccgtcctgcaacgctttcacgacgatataatccgcctgcgcctctgctttcattttcgggcctcctttttattcgtttaaaaaacttttcatatattcatcttaccacagcgccgtttgcagtcaaagcgccggaaacgccgcgctcaggctttccccggctgtaccgggatttcgcaggcatttgcaccgggaaaacgggcgccaaacgtatgcacgtttccctttttccgttttttgggccctgctgtattaaaaaaaggctgcccaggcagccttttttccgctcaaagccaaccatatgtaattacttcactgcgtctttaagcgctttccccggcttgaatgcaggcactttgcttgccgcaatgtcgatttcctcgccggtttgcgggtttcttcctttacgggcagcgcgttcgcgcacttcgaaattaccaaacccgatcagttggactttatctccgtttgccaatgcattttgaattgtatcaaaaatagcgtcaactgcttttgtcgtatcttttttggaaagttcggtagcttctgccactgcattgattaaatccgttttattcattccattcacctcctccaaaagaaacgtagaagtcatttccagtttcttctcttcagtgtatacggttttccctcatcataaacgtttaaaaccggatagaatcaggcttttcagcaccaattctgttaaaagattatcataatcgcaagagaggtgcaagaactattcgctaacaaaggaaaacttttcaatttttttcggatttaaagtacttttcccgaaaaaattctaacttgcggccaaagatgctcgtcccacgtatacaaaaaagggataccgcggtatccctcttacaaaataatggcgatcaggccgcctgacccttcgttaatgatccgttcgagcgtttcttttaacttatagcgggcattttccggcataagcgataattttgcctggatgccttccctgacaatggaacttaagttgcgcccgaaaatatccgaattccagatggacagcgggtcatcttcaaaatcctgcatcaggtaccgcacaagctcctcgctctgcttttccgtcccgatgatcggggcaaattccgattcgacatcgactttgatcatatggatggacggcgccactgccttcagccggacgccgaaacgggatccttggcggatgatttccggctcatccaggctcatatcctgcagggaaggtgaggcaatcccgtagccggtttgtttcaccattttcagggcatcggaaatttggtcgtattccgattttgcatgggcgaaatcctgcatcagctcgagcagatgatccttgccgcggatttcgacgccgacgatttcctttaaaacctggtcgtacagttcatccggcgcctcgaggtcgatttccgccaccccttgccccatttcaatgccggcaaggcttgcagattcaataaattcatattcgttaaaagcctggacaacgcggtccacatcgcgcagccgcttaatgtcttttaccgactctttcacggcgtcctgataattttcacgcagccagtggttttcttttaacaccatgacccagctcggcaggttcacattgacttccagtaccggaaattcgtacagcgcttcccgcagcacattcagcacatcggcttcacgcatgctttccactgacatggcgagcaccggaagatcatacttttcctgcaattccgccctcagcatttccgtctccgaatgatgcggctttgccgaattgacaacaatgataaacggtttgccgacttcttttaactcggcaacaaccctttcttccgcttccacgtaatcctcacgcggaatttcgccgatcgtgccgtctgtcgtgatcacaaccccgatgcttgaatgttcctgaatgacctttctcgtgccgatttccgccgcttcgtggaaagaaatcggttcttcataccacggcgtatggatcatgcgcgggccgttttcatcttcataacctttcgcgcccggaaccgtgtagccgacacagtcgacaagccggatgttcacatcaagtccttcgtcgacatggacagcaaccgcctggttcggcacaaatttcggttctgtcgtcataatcgttttcccagccgcactttgcgggagttcatcctgcgcccggtttctgtccgcttcgtttgtaatgttcggaagcacaacgagttccatgaattttttaataaaagtggatttccccgttctgacggcgcccacgacccccaaataaatatcgccgcccgtacgttctgcaatatctttaaaaatatcaactttttccaatttgtttccctccccacattcgttcccgggacaccatcattcgcgctgatgataggacattatatgtgtatgatgttgtccgaccgccttatgtctataaaatgattttttatagattttcaaaaagttgctgtacaggatttgcccctgtttattttttcaaaatttttccttacgaagagacgcaggaccaaaaaataaaccctttctctaacaatatattgggatgagaaagggttatgactattttgccataaataccggttcatttttttgatttacggtgcagggaagggaataagccggtacaaacggggagccttcagttaacagcacgcggatatcttccccgggtttaaacgcccgcttgcccgttttgagcgcttttgtcagatcagcccggtaatcgacataaatgccgcctctcccggtaatgacaaacggcagtttccggccggtatacggagacaccacgtacggatctgttttgtaaccgagctttttaaaatctaaagcgtatacatttcttgcaatctcttttttaaatggcggatagccctgggacgcaatccggatttgcaagtctcttattttctcgggtattctcgtatcaaacactttgaccgtcggatgatgttccggatcaaggagcacatattgcaacgtgccgccgttgtcatacgcatttgccggcggatcgggcaggtagtttttcgggcttttcagcttgttgaaatcaatcgggtattttaaatagaccggcgtattttgcggctttgtcttgatcggaagcaggccgctattgtctttccggtattcatctacagctttttgcaccatttgaagctgcatgtcatccggcagcccgctttctttttcctgtgcccccggataaaggcagccgcctaaactgatgcaggcgcaaacagctacaagcaatagcagcatatttttgaagtgcaaaacgatctccccctccggttaatttgccggcccgctcagcacgatataagccataatcaggccgcccagcgccaggcaggcatacgcaatcacagcagccgcccatttgaacagtttttgtttcagcctgtatcggcttgcaacaatcaataccatcgccaaacagagcaggcccatgccaaaaagcgaaatccacatattcgccatcccccgggacaaaaccatctcccctttctcccttgtaaaattcgtaaacttttcggacttcggacattatatcataagcttttgaaatgtttcaatttacggcataaaaaaggccggggcgaacgtctgccccggagaaaaggttgactatacccagcctgcgcagtttaaagcgaattctttttccttgcagtttatgcaacatgcatccatccggtatcgtccgaaagcctaccgggacttttttgccaagatgcctagtactgttcccccagcatatccatcaaaccttccatttcatgttttttcagccggcccattaaattgtcgactgcttctttcggatcaagtccttcaaataagacatggtaaagggcatcggtaatcggcattttcacttcgtaccggctggagagctggtaagccgcctttgttgtccggacgccttccacgaccattcccatttgttccagcacatcatcgagctttttgcctttgccgagcatattgccggcccgccagttccgcgagtggacactcgtacacgtcacgatcaggtcgccaattccggcaagcccgagaaaagtgagcggatttgcacccattttagtgccgagccgggcgatttccgcaagccctcttgtcattaaagccgctttcgcattgtccccgtagccgaggccgtccgaaatgccggctgcaagcgcaataatatttttcagggaaccgcccaattcgacgccaatgatgtcgggattcgtatagacgcgaaaattcgagttcataaaaatgtcctgcgcttttttggcagctgccatttttttcgatgaaacggttacggtcgtcgggtggcgcaggctgacttcttcagcatggctcggccccgataaaaccgtgagatcccgcagcaacgattccggcatttcttcttcaatcatttccgaaatgcgcatcagggaacccggttcaatccctttcgtgacatggatgatggaaagcgggcttttccgcaccgcttttacttgcctgcatacatcacgcaccgcttttgtagggaccgccagtacagcggtatcaatgtcgtctaacgcttcttcaagtgaaaagatgccggtaatggcagattgcagctgaatgcccggcaaataaaacgcgtttgtatgggatgtattgatttcatcgatctggccttttttgtttccccacaacctgacctgaaagccgttatcagccaaaacaatcgacaaggcagtgccccagctccccgcgccgagcactgcaatcgtttttttggacaaatgaaacaccctctttatgtttatttacgcgcacgggcgatgatgtggatcggcgttccggtaaaaccaaacgcatcacggatccgattttccaaaaaacgttcgtacgaaaaatgcatcaattcgggatcattgacaaacacaacgatcgtcggcggtttgacggagacttgcgttgcataaaaaattttcagccgccgccctttgtccgtcggcgtcggattcatcgcaaccgcatccgttataacttcattcagcacgctggacttcacgcgcatcgcatggttctcgctgaccgtcttaagcagcgggaacagctggtccagcctctttttcgtttttgccgatacgtaaatgaccggcgcataatcaagaaactgaaaatggtcccgaattttctgtgtaaactgattcatcgttttttcatctttttgaacggcatcccatttgttgacgacaatgatcacgccgcggcccgcttcatgggcgtagccggcaatccgcttatcctgttcgcggatcccttcctcgccgtttaaaacgacacagacgacatcggaacgctcaatcgccctcaatgcgcgcagcacactgtatttttccgtgttttcatacacttttccttttttgcgcatccctgctgtatcaatcataacataagtttgatcttcataagtatagacggtatccactgcgtctcttgtcgtcccttctatgtcgctaacaatgacgcgctcttcgccgagaatcgcattaaacagcgaagattttccgacgttcggcctcccgatgaaacaaaatttaatgacatcttccccgtactcctcgtccgctttttccggaaaatgtttgacaactgcatcgagcaggtcgccaaggccgaggccgtgtgcgcctgatatcgggaaaggatcgccaaaaccgagggcgtaaaaatcataaatctgggtgcgcatctcgggattgtcgaccttgttcactgccagaacgaccggcttttttgaccggtacaatattttggcgaccatttcatccgcagaagtcacgccttctctgccgcttgtgataaaaatgatcacatccgcttcctggatggcgatttcagcctgctgccggatctgctcgaggaacggttcatccccgatatcaatgccgcctgtatcaatcacgttaaattcgtgtgtcagccattcagccggactgtatatgcggtcccttgtcactcccggaacatcttccacaatcgaaacgcgctctcctacaattcggttaaaaatggtagatttgcctacattcgggcgtccgacaattgccacaaccggttttgccatacgattcaccctttctgttccgttttcgcaaaacaaatcaactttagtagtttatcaatattttcttgttcaagcaatatgccgtaattcatcctggcttttccttttttgccgctctttctgagatgagattcaaggcggtatcgatgaaatgccagccgcacgcgtagaggagaaaaagcccggcgatatcgagatatgccgcagatcctgccgtaatatggaaatcccattttgcaagcacgagcgcatacaggatttccccttgtgccgtaccggtgagtgcagcggcaacagcatccatttttgagcgaaaaagcaaatggacaaggataaacaaaaacaggctatagcaaatagtacgccaggcaaacatccagaccggatcgtacagttcaaataacaacaggcctgcataacctgtcatcacgatgaagacgccggcgagccggaccaaaagtgcccatttcgaaaatctgccgaagtacccataaccggcagccataatgacgatgagcgcccagctcatatcaagacggcccaccgccgcttgatgcggaaaggcaatcaaaagcagcaaagcaaccagtgctgccggaaaccgcaaagggtgatccctttccagcaaaaatgtcgcccaaatccataccgcccacatcacccccaaaaaaaatgctccttccacggtgcaccctcctttatctccattatgggaaagattgcaccgggttaaccgcaagtttttcgcttttttcaggcatactacaagcgggggtgaatgggcaatgggaaaagaccgccaggagaaaaaactgcgccaaagcgggcgtgtagaaagcgaccgtgaccaagcgctccattacggaggggcaacccgcctcgaaagcgctgacgcagcacgcaaacggcagtaaagaaaacggtttatagaaaagacaaagcgcaaaaaagctgagcggcaccggcaacccgggcgccgctcagcttttccattccatccggacatttttactgtttaaatttcttcaactggtccccaatcatatccccgagctggaacccggtattttcttcaggcaggtcataatcagaagcttctgtatcggcctgttccagttctttcatgcttaaggacaagcggtgtgcctgttcgttgacatcgagcactttcacctgcacttcctgtccttcccttaacacttcatgcggggtggacacatgcttatgggaaatttgtgaaatatgaacaagcccttcaacgcccgggaatacttctacaaacgccccgaacgaaactaggcgttttaccgttcctgtaaggacagtccctttcggcgctttctgttcaatgccttcccaagggcccggaagcgtatccttgatggacaaggaaatccgcccgttgtcccggtccaccgacaacactttcactttgacttgctctccttcttggacgacatcggacggcgtttccacccgttcgtgcgcaagctgggaaatatggacaaggccgtcaattccgccgatatcgacaaaagcgccgaaactcgtcagcctttgcacggtcccttccagcacctggcctgcttcgagatggtcaaggatatcctggcgtttttcttctttttctttttccacaacagctcggtgtgataaaatcaaccggtttttgtcttcgtccagttcaacgatcaaaaagggcaatgtcttccctttatagtcggagaagtcttcaacaaagtggtcctcgacaagggacgcaggaacaaagccgcggacacccaaatcgacaacaaggccgccttttaccacttcattgacttccgcttcaatgatttcctggttttcaaatttttccttcagctcatcccaggctttttcagcatcatatttccgtttggaaagaatgacggcgtcttcttccactttcgtaacgacgagattcagctcgtccccttctttcacggcatctgatgcggtttcaatatggagattggaaagctcgctgatcggaataatcccgtccactttgctgccttcaatggaaacgagcacttgcttttcctccactttgacaaccgatgctttcactttatcccctacagaaagggaccgtacttctatttcattcatttcgtctgacatatgtacttcctccttatccggcgcttcaactaccattgaatatacccgttcttttcaaattaattcgtataattcaaaaagaaacgctttcctatcaaatttctaacatcttttactttttgtcaagtaaagaagccgattgctgctgtgccattttttcttttgccatcgcaagaatctttccggcaacttcatcaatatccatgcttgtcgtgtccagttctacggcgtccgccgctttagagagcggtgaaacttcccgttcggaatccagcctgtccctttcctcaatctcctgttttaaacggctgaggtctgaagggatcccttttgcaacattttcggcatggcgccgctttgcgcgctcatcggcgctggctagcaaaaaaattttcaattcggcatccggcagtacttttgtcccgatatcccggccgtccatgacaacgccgccaccgcgggcgagcatccgctgccgcttgaccatttcttcacggacaacggcatgctttgaaacagccgaaactgctctcgtcacttccctttccctgatcttgccggttacgtcttcaccgtcgacaaaaacgacctggccgttttcccccggctccaggcggatatttgtcttgtacaaaagttcggcaagcgcattgccgtcttcaaggtccgttccgtactgcagcgctttataagtaagcgaccggtacattgcccctgtatcaatgtaaatatattgcaactgctcggcaacttttttcgccgccgtgcttttccctgcagcagcaggaccgtcgatggcaatattgatttttttcatacaacgatttcaccctattctctcttgttgcatatacccgttttttgggcagataaaaggatacaccctttttatagtgtaccataaaatggtgaatcctcctatccatgaaatgcaagttttatccggaaagcccctttttacggagcaaaagctgctgctcgaagcaaaaacgcaggatatactgcctctctttcgcgcttgtatttttaaactggagcgaggcccctgtttttccgccggtttcaaacagcctaacgacggaaaaatgcagctgtaagtattggtaaccttcttttagcggcaggacaagaagcgcttttcctgtttcatgctcccttgggcggatatcatcaggcaaatagaccgcacagccgcccgaactgatgtcttttgtaactgccgttgttttcaaattggattccggaaaggtgagggcaatatcgagtgcggcgtctaccctgacatactgccgtcgctggattttgcgcacatcttccggatcaggagcggataaaatgagcatcgggatattgccgagttccctgccggttacttttgatgaaaaccggtaaggaatctggccgtccgaaacgaaatcaacgagcagcccctggccgagcagcaaaaatacggtccggtttgtttccatgtcgatcgggtaatcaatataaattttatcctcttttatatccgcaattttacatctatatcttttacctgtatctttatcttccagtgtgagttccagcccgacttttaacatcttcccaaaccccttttatagattccaatcttattatgacacaggctgggcagttttgtattcttttttcgcgtttcatttcattttttgccaaaaggcccggctgtacgccgggcaatgctcatatggacttgccgtatgctctttccgtgtttttcagcttttccactttttcttcgttgccgttttccgcgttgatataaatccggtacgtttcatcatgcaacacgccgagaaattcataacaaagcacttcccggttcatgtcgccggtcatgatcgcaaggcggctttccataatgtcaagcttcggattcacacgggaccttgcttctttttcgctgatggcgggctttggaatatcccttttttgatggcttttcagaaaatcatccgctacaaacccgatcacctggccgttgtcaagcgccacttttaatttgaccgtttccggataaatgcggacattcccctgtttcgcagcgaaagaaaaaacaccgacgttgtcatattgtgtgctttcaaacatgtccattttctcaaaatggtgccggtttaaaaaatccgccgctttcttttgggcctcgtttaaactgattttttgctttcccaccggacgcttgttgaaaaaccagaccgggtatccccctttccgcgtcacatctgcggttgtttcattgccgtttttgtcttttatacggacggtgtaaaaagaaaaacgggcgcctttttgattcggtttggcttccgcctggcgggccgttttgagtccggcgtattgttttacagtggcgaccgcctgttttttgctgatcatttttccttccaggtgctcataatggtcatcgcggttttggaaactcgtaaaagacgggctgttcaaatcggcattgtcatagcctttgaccgtcctttcgaccgtcttaaagccgtcgatgatcgtgttatccttcgtttcttttccttgggcaagggcgcgttccacgtccatccagcggagattgtgctttaaaacattattttgcacgccccggagctggtcctggatatccgcgctctggccgtacagttttttcagtgaagcatactctttatcggatagaggttctttatccaaatcgcgcaccgccgtccggtagctgaaattcccgatattagtcagaaattcttccgttttatgaaaaggcagaagcgataacggaagttggccgacatccgcatgcgcttctgatgtcaggcgccatacttcagccagtgccggtgaaagggacttgcgtgagttcatggcgagggtgtttccgatttcatcatgcaaaaggtccattctgtatgcaaggtcatgaaaagccctttgatacgtgctttctgcatttaacaagaccgcctctttttcacggtgctctttatatgcccaggcagcagtcccgcaaagcccgagggcaagcacaacaatcattgcccgtttcagcatattcatttccccctcttatttacaaaaaatatgtttgccgattcgtttgatttgcggccttgaccagatccacttgcttgttgcggtcgccggattaaaataatacagcgcattaccggacggatcccagccattgatcgcatcgaggacggctttttttgccgtatcattcggcgcaagccagatctgcccgtcggaaacacaggtaaacgcacccggttcgaaaatcacccccgagatggtgtttggaaaagacgggctgtcaatacggtttaaaataacagccgccacggccacctgcccttcatacggttcgccgcgcgcctccccgtaaaccgcttgcgacaaaaggcgaatatcgttttgcgaaaatccgttcggcacattggtagcggtttggacgggttttttggctgccgttttcggtgcctgcttttttgtgccgccgtaatacgtgaattttttcccgcttgcaaccatggactttacgtatgccgcatcgtattttgacgctttgacgagtttcgctttgacgcccgggccggcgaggccgtcaacaggcattccgtatgccttctggaaatttcttaaagcccagtaagtgctgtaaccaaacaccccgtcaatcgttcctttatagtaaccgatgtactgcagcctcgcctgcagttcaatcacatcatccccgaccgctcctttttgaatcacctgattcgaaaacgcccgggccgtcccgcttgtgccaaaagaaaacaaggccaatacggcacaaagcagcaacatgtattttaagcgattttttccaatcataccgcaccccccaaaaactttaagcattatccgtagtttctggagaaggcggcaattttatgcaagacataaaaaaacaaccggcgattgatccggttgttttgcccattatcataattgttgtgtccctgccgcatcctgcgcaaaatgtttggcagaaaggctgtgcgcctgctttgcttttttcaggccgagccaccaaagcccgagcataaacggtaccataaaatacagccatttttgctgggtgagcatgatccagtcgtaaaaaccgtgcaggatcaccggcaccataaaagaaaaaaggaaccagcactttttgcgcggggagaatctggattttcccatataaaagcccatcatgacaccgaaaatggcatggcttgatacaggaagaagcgcacgcccgaacgccaggtcaacgccgcccgaaaaaagcgataaaatattttcgagcgtggcaaatccgagcgagacgctgacgccgtaaacgatgccgtcaaaaggttcatcaaattcccggttaaaaaacacaatagcggccaaacacagccacttgcaaagttcctccggcaaagcggaatggaggaaagcatgccagatgctgcccgaaaagagatgctcccgttcgaggataaactgcaaaaacataaccggcagcgtgacaagcgcaccgtataaaaacgcttttgcaacaacaagtatcggctctggctcaaactggtcccgcaaataaaaatagcatagcagggcaagtccgggggcgatgccggctgacaaaaggacaagcatatcgaaacctcgctttttgcaaaactcaaatgatccgtgccaagtcatttgttttcatcgtaacatgaaaaagccggaaaagaaatactgccccccgaaaaaaccctttaatttcctttttgcaagagagcctcccggtttttgatcgctgtggcaattacaccgccatggaaacgtccgttttcaataaaaatctcattggcattgtttccggcagcaagcacgcccgcaataaaaatcccttcaacattcgtttccattgtctcttcgttgtaatgcgggcggcctgtttccgggtcaacgtccactcccattttccgcaaaaacgtatgatccggatgataaccgaccatcgcaaatacaaaatcattccggatctctttcacttctccgcctgcttcgtatacaacgctctgttctttaatttcttttacgtgcgcctgaaattccattttcactttcccgtggcggataagcgaatcaaattcaggcaatatccacggtttaatgctttcggaataatgatcgccgcggtacagcacggtcacacgggcacccgccttgtgaagctcaatggcagcgtccacagccgagttttttccgccgatcacacaaacatcggtgtcaaaaaacggatgggcttctttaaaataatggtacactttgtttaaatcttcccccggaacatccagcctgttcggattgtcgtaatagccggttgcgacgaccacataaggcgtctcatattggccttttgtcgtcgtaatggaaaaggttccgcgtttcttttcgacacggagcgcttcttcaaaccggtggatgcgaagggccttcagtttcgccacttcacggtagtatgtaagcgcttggttgcgtttcggctttaaattttcggtaataaacggcacatcaccaattgcaagccggtcgcttgaactgaaaaaagtctggtgcgtcggataccggtaaatcgcattgacgacatttcctttttccagtataagcggatgtttcccgatttcctgcaggctgattgcagcagccaatccgcaagggccgccgccgataataatacaatcttcttttcgcatgtttgtccactcatccttttttcgtatctgccttttcgttttcatccgtttatttaaaaatctcccaccgtgaacacgacaggagatttcagcctttccttcttctgaacctgtaaagccccgtttgctgcccagctggagccggctttcggaaactctaaatccagcctctgaaccgcgaagcttccgccactcttctcacaccgatcatataagcggcaagccgcatgttcacccggcgtgagcgggaagtattgtagaccgtattaaacgcctggacaagcactttttcaagcttttcttccacttcttcctccgtccagtaatacccctggttattttgtacccattcaaaatacgaaactgtgacgccccctgcagatgcgagcacatccggaacgagcagaatgccgcggttggttaaaatttcggttgcttcaagcgttgtcggaccgtttgctgcttccaccacgattttcgcccggatattatgggcgttttcttctgtaatttggttttcaatggcggccggaacgagaatatcgcaatccagttcaagcaattccttgttcgtaatcgtatttttaaacagggttgtaaccgtcccgaaactgtcgcggcggtcgagcaaatagtcaatatcgaggccttccggatcatgcagcgcgccgtatgcgtcggatatgccgatcacttttgcgcccgcatcatgcataaattttgcaaggaaacttccggcattgccgaacccctgaatgacaaccctggcgccttttaaatcaatccctttttttctggccgcttcacggatgcagatggttacccctttggccgtagcggattcgcggccgcgcgaaccaccaagcacaagcggttttcctgtgataaagcccggcgaattgaattcgtcaatccggctatactcatccatcatccaggccataatttgcgaatttgtaaacacgtccggtgccggaatgtctttcgttgggccgacaatctggctgatcgcccggacatagccgcggctcaaattctcaagctcgcggaaagacattttccgcggatcgcagataatgccaccttttcctcccccatacggcagattcacaatgccgcatttcagcgtcatccagatagataaggctttcacttcattttccgtcacatccgggtgaaaccggacgcctcctttggtcgggccgacagcatcattgtgctgcgcgcgataccccgtaaaaatcttaaccgtaccatcatccattctgacgggaattttaaccgttaacatacggaccggctcttttaaaagttcgtatacttcttcagggtatccaagcttttcaagagcttcgtgaataattgtctgtgtcgatttcagcacatctcgacttgcttccattgtttgatgatctgcgcccttttcggctgccattatcgcaaacctcctagatacgaaagaaatatctgctatcaaatttagtatacaactttccccagcagatgaaaacctgaaaaaacatggcggacggttacgggaaatgcttcaggagttccgcaagcgcattttcctcaaacaccgcgatcccgtattcccggaccataaacggggaaatccgggcgcgctcgccgtattcaagaataagcggcgcattttgtgttcccggtttttgcagcaaataatactggtcttcgaatatataaaggctgcacgcggaaatccggccgatctggtttaaaaagcccgcaagcgcaatcacttcctcaatcgatggaaaaaagtaggcttcttcctgttccagcgtttccggatccgcccattcgcccggatccgcgtcgtccgcttcgcccactgtcagaataaacaccaattcctggacattaaatgaatagatttcaatggtcagcatatcgctttcgccgacatggtaagcctgatccgccaactccagcatttcttcaaataaatgattccaaatgggcgagtcgagatcgttttccataataccgcgttccgataactcttcaaacgtaatggagtatttaattttattggatgaaatccgttccagcttcattgatttccgccccctgcatacggatcttaccttatcgtatgcggaaggggaaagatggttcatgatggccgcctgctgctttcgatcgtaattaaatgggcttccggttttgcacaaagcctgagtggaacaagtgtcgtgccgtaaccgttgcttatgaggtggatgacattgcgcacttttctcaccccgccgcgcctgtaacggctaaggccgagaatacgaatctgcccgccgtgcgtatggccgctcagcatcacatcgatattgtcccattcatgaagctggtggatcattttcgggttatggctgattaaaatccggagatcgtccggctgcaccgattgaagtgcttcatcgagattttcgttttccgtcgtcaaatcatccacgccgatcagcgcaattcgttttttcccgtttacatatacaaaatccgccgcgttgcgcagcgtgcggacgccggttctggcaaaaacggtcgcgagcgcttcgccgtccgcttcataatcattatttccccacacaaaaaataccgggccaatttttttcagcaaccgcaaattttcctctgttctggaaagcggaacccccttttccagcaaatctcccccgattattgcaaatcgtgcttctcctgttgcctcttcgaccagcctgggatcaattttgcgccggtggatatcagaaataaagaaaaaagtgcacggctcctctccggccggatactcatcaagcaaaaaccggtgccggatgagccgatttaacgatgcttcataatgcatatacatcaataaaacaatgccaagcaaaaaggcaatcgataaaaatgcaaacatacacgagtgctcctgttccgccgggtgctggccggcacaaacgaaattttctgcaatccctatccgtattatatcttaatcatggcagatagaaagcattccggcattgtttttgacatagcgggagagaaccgcacataaaatgaaaaagacttttaaatgtcaggaggactgagatgaaaaaccattataaaacgtatcatccctttatcggaccgtttgacccctgcccgccgataaccgaaaaagtttactccaccccgccgaatttgtatttagggtttcagcccccgaaccttccgcaatttgcaccgcaggaagcgttaaggcgcgggacgctttggaggccgctttatgacccgtattacagcccttatgaacgggcaaaggaggaaaccgattgaagcagctgccaaaagagtattacacaaggcttgaagaactgcaggcccttgattttgcaattgtggagctgaacctttatttggatacccatcccgatgatcaggcagcgatcgaacagtataacacttttgtccatgccaggaaaaaagtcaaaagagcatttgaaaaacagttcgggccgctgacaaacttcgggcacagctattcgccaacgcctttccagtggaaagagccgccgtggccatggcaggtataagcaaataaagggggaaaacgttcatgtggatctatgagaaaaaattgcaatatcccgtccgggtctcaagctgtaacccgagacttgcgaaacttttaatcgaacaatacggcggagcggacggagagcttgcggcagcgctccggtatttgaaccagcgctacaccatcccggataaagtgatggggcttttaaatgatatcggtacggaagaactggcccatcttgagatgattgcgacgatggtcttaaaattaacaaaagatgccacgccggaccaattgattgctgccggccttgacgcgcattatgttgaccatgataaggcactgcattaccataatgccgcaggggccccatggacagccacctatatccaggcaaaaggggacccgattgccgacatctatgaagacattgccgccgaagaaaaagcgcgggctacgtatcaatggatcatcaatttaagtgacgaccccgacctaaatgacgggctccgctttttaagggagcgggagattatccactcgcagcggttccgcgaagccgcgcaaattttaatggaagaaagagacagaaaaaaaattttttagaagatgccggggcatcttctttttttcggcggcttttagtctccgtacctgttccggtgaatggctacttgttctcgtggtataaattaatatcaaactctttttgcatcatttcgaatacaaggtggcgatccttccagctttcccctttccataaatctttgcttttatcaataatttcgcagcggagcgcatgaaattctttttcagccttttcccgcttgtcaaacaagattttgctcatgccccaaagcgcagcggccaaaagcaggaaaaacaggtgaaacgggctttcagaaataccggagaaaacggagaacacggaaccggcattttcaaaagacctgtaaacatagtaggcccatgcgcatgtgtagagcatgcttgtccaaagaaaaacaagatgccgcttccgcaggcggtcaaatttttttttgcgtttgacagcactttgcagcatctgctttgtcgccgcatctgtcccttttagcccggtgatggacggctccatactgatcccccctcactctactatatgcggcaagggacagatccatgacaagcaggcagctgccctgtcctgaaatttcgccggcagattctcctctttttggggcgccatttatcgcgggatgggcatctatctgaaaaacaaaaacgtataacagatgtaaacggcaattggcactaaaataaaaatgacagccaataggttcacaagcggcaaccgggagcgggattccttttcggtacttttccgcttttctgcccgcgaaacggccgccgccgtttgtttctccgttttttcctttgctttgccggccggttcaagcttttgccgccgtttttccatttcaatgatatatttttcgtctgacatggcttccccttccccacatccggactaaatcccctgttttttgatgcggatacctagtaaacaatcgattgtaaaatgcatgatgatgaccgccggaagattttcatgagaaagcacataaacggcaccaatccaaaaactcaaaagcagcacattcgcgattaaataccagtggccaaaataccggatatgcatgagtgcaaaaataaggcttgctgccggcaatccaaaatgcgtctggatggcgccccgaaacaagagctcttccgccaccgcgatcagcgccgttaaagcaataatagacggaaccgaacgggttttaaaaatccgctcattcacgcccccgtcatcataatacgctttcgggagccatttcatgagcaaagtatccgcaaaaacgacagcaactccgtttaataaaccgtatgcacatttcgcaaatgacatacgaaagtgctgaaaaaatgctttgccatccggaaataacagaaatccgagcaaagcggcagcaaacaggagaatcagctgtgtcaaaattaagtgaaaagtaagttcccggtctgtgagttccttgatcaaatccgcctgttttcttcgtgccatttttgttccccttttctgaataggtcctgcaaaagcaattcccatgcaggaacggtttcgagggtgcccccgcttttttgattgctttcatataaggctgtttcaaggccgcaaatgtcacagcacgcttcattgccagcagcgggcggttcaccgaaataccgtaaaatttccgagcggcggcatgacgaagaccggaccatctgcaccatttcctttaacttccggcgcttgtacgccatccgctcgttccggatggctgcaacctcccgggtccatgcttcttccggcaggttaagcactctgtggtgcagcagaaaccggagttgcggttccgtgcatccaagcgccgccccggcttccttcaaatctcctttccatctgctgaaagcggccaattgtgcatcagtcggaagctcagcctcgatcagctgaagcgggagccgttcatccccttccgtatacaaaaggacggcaatgctcgggagcccgtcccgcccggctctgccgatttcctgcagataggcttccatctgcaacgccaggtgaaaatggatgacaaagcggatatctgctttgtccacccccatgccaaacgcgcttgtcgcacaaatgatcccgatctgtccgtaaataaactgctgctggatcaaaattctttgctcctggtcaatgccgctgtgataggcggccgcttcggcgatcccctcctgccttaaccgcgccgccatttcctcagccgcctttttgcttgaaaaatagatgatgccgggcttctgcaagtttttcgcataggcaactagtttttcctctttttcgcggtatgaaggaatccggtctattttaatggcgatattgggcctgttgacagaataaataaaccggtttgggtcttttaagccaagatacttgcaaatatcgtccctcacctgttctgttgctgtggcggtcagagctagggtaagcggtgtgcccaattgtttccggacttcgccaaggtttaagtattccggcctgaaatcatgaccccactgggaaatacaatgcgcttcatcgactgcaaagagcgcagtccggatggtttttaattttccgaggacatagcgattgtgcagcatctccggcgagacaaagatgaatttgaaagcgcccagatgcgcaagggccgcttcccgctccggaccggttaaaaacgaatttaacgcaaccacacttttttcgccgcgcattttcatctgctctgtctggtcctgcatgagcgataaaagcggagaaacaatgatgcaggatccgtccagcaaataggcaggcaactggtagcataaagattttccggtaccggtcgcaagcatcgccagtgtatctttaccgtccagcagtgaacggatgacttcttcctgccccggccgaaatgcgctgaacccgaacttacttttcaaaaagcttaaaagatccactgcggcccatcctttctgccaatacaaggcgaatatggaaatacgggatgtcccctactttttctttaatcggttttaatttctttgtatttaaatcagcggctgcccggatgatcttttgttcttcatcctttggcacataccggttcagcggaaaatctgggaccgttaacgcgatttcaatcagatggtcttcaatcgtgctttgttttaaccctctcagcgtgctgatttccgcaatcgttttcccttgcttcaagaagccgaatgtcaccgcggcagaccgggtcagtggcaaggccttttgcacatcgtgaagcatttggtataaataccggaatgtttcaggatctccgaggatgcgccggacgataaaatgaagcaaatgcaaaaatcggtaccagtactctacaggatcaaggtgcagggcggaggcagcctgcgtgatcgtatatccgatccggcccgcacccgtcaaccgaaggacaaaaatttcaggcttttccggtgggctgtcggaaaacagacggtaaaattcacggtacaaatgctccgctaacgcaatcctgctttttgcatgctgtttcagccagttttttgcccaagcctgaagagccgggtccctttgaaccggataatatactttatttccatacactaagttggatacggcctgggtgatgagattcaaccttttccaaaacagatttgccgaatcctggtatttcaagccatccagattaggaaaccgttcttccatcctgccggttgccaaaagcagggcagcgcctttttctgtgaccacgcaggcatccgggccgcttttttgtagtaacccggcttttaatagggcctctacttcgcgtgtgaaagcctcacgggaaataaatggaaacgtttgaaagagcctgtcaatcttgaaaaaatgggaatcctggatcgtctgtgctgattttttgccgtttaatagatgaaaaacagcataaggggtgcgttctccattcaggttgctgaagcaatccagcaatacagcctgtaaaaaaggcatctgaatcctctcctattctttagctgaaaaaaggggaaagtgcaaggaaaaatcgggggttggttctattttaacatggaaaccggcgatttgtttaccatttttttcattgattcgacaggtttcacgaactccgccagcccgctattgaaataagaaaaaaagagttttaaaatgaaggagaaacaccggcatgccttcgtgcacatgacgaggctgcctgtttttcttttctgccatgattgaacaacgaggaggaatcaaaatggcaaagtttacaatcgtggacaaagatacatgcatcgcttgcggcgcttgttccgccagcgctcctgatattttcgactatgacgatgaagggctttctttcgtgattttggatgataataaaggcactgcggaagtcccggaaatattggaagatgacctgatggatgcctttgaaggatgcccgacagaatcgattaaagtttccgacaagccttttgatggcgatccgttaaaatacgaatgaaaaaaagcaggccgtttgagcctgctttttttcatattctttttcccccaatggcggatgctttgtcaatccaatttttcatttttgtaaacatgagcataaacaaaaccgtcacgatgaggcctttcacaagattaaaaggcagcacgcccgccacaatatacgcttttacattcccgaccgaaaagttcatgaagtacaggtaagccggtaaaatgacgaaataatttaaaatgctcatacataccgacatggataccgtgccagtgactagacctacagtcatgcccttttttgtccgcatccgtttgtaaatgagatatgtcggcaggacgaacagcatccctgcaaaaaagtttgccacatttccgatcggtacccctgcttcactgccgagcgataaataattcaggatatttttgatcagttccgctacaacagaagccattggcccgtaaagaagggctgccaccaataccggaatgtcgctgaaatccactgttaaaaacgatggaaaaggcggaaccggaaatttaataaacatcagcataaaagccagagcactgagcaacgcgaccgcaacgaattgctttacatcccatttcttcatttaaacttcctctctccttgtgaccgatttatcatcaaaggaagaaaggtgccgcggaccaaaatgaaaagcccctgacaaaatgtcgggggctttgtaataggcgagtccaaataagcgtttaacacgtcattaaacactggcaacctttatcttctcccatccagactatactgtcggttttggaattgcaccaaatcctgccggaaatccggctcgcggactgaaaggcaactgccttatcaccgccggtcgggaatctcacccagccccgaagataaatcgtatgaaattttgattacaagcttattatacatgccggctgccattttgtgaagcattccgcaccactttcattcattttttattttcagcacctggccggccataatccggtccgaccgcaatttgttccagcttttcagcctgcccacgctcgtatgaaaatggagggcaatgttccagagcgtgtcgccttttttcacagtgtaagctccaggctgagggacggcggaagcatcaaaaaccccgtaaggatcatgggcattggcggaaaccgtctggcccggcgcgcctggtccgaagatcaaaaacgggtcaatggcgtttttcttatccggcgtccatggcccgttatgcacttcaaaatgaagatggataccagttgaatggccggtcgaacccatatagccgaccacctttcctttttcaacatgctgccccgctctgactgcccttccggcaagatgggcgtaaaccgtttcataaccggacggatggcggataaaaacaacatggccgtaggatgcggacaaataggaacgggtaacggtaccttcttgggcgctgaatacttttgcgcggtatcttccggcaatatcaagccctttatgtgtgccgtatcttgtgttaaatgtgtcggagatcgtccctgccgccggaaaaatccagtcttttgtcgcttcatggataaccgacccggatgcggccacgtcatttgccgaacaggcaaaccccaggcatgcagctgtcaatgaaacgaaaaggcatattttgatgtatgccggcaattgatccaccccattttcattttttcaattccgtttcaagcaaagccatcttctaagatgcgcaaaaaaacgggaaaatatacaaaaaaaggcagacccggcgcaaaggtcagcctttttttggaaggaaaaatgaaaaggtggtcccttcccctaatttgcttttgacaaagatccggccaccatgcccttcgacaatgtttttggcaatcgcaaggcccagccctgttcccgatttgccgcgcgtccttgctttatccgctttgtaaaagcgttcaaatacaaacggcaaatcttcatccggaataccggatccgttgtcttcgacgtgtacatatacgccgccgggtgcttcttcctcttttactttgacgtaaccgttcggggaagtatgccggagggcgttatcaattaaattcgtcagcacctgttcaatcctgtcggcatcgatttcaagggtgagatcgctgtccgaagtctcgcaaacgaggtcgattcctttttctttcgcgatgccgttaaatttatgtgtcactctttcgatgaaactgttgaatgagaccggctccattctaaacgaaaaatgccctgcttccattcttgccagatcgagcagctcattgacaagccggccgatcctgagcgtttcatcgtaaatgattttggcaaattctttcttttcttcttcacttgccgcaatatcatcaatgatcgcttcgctgtatccctgcagcatggcaaccggcgtccgcaattcgtgcgaaacgtttgcgataaaatcatcgcgcagcttgtccagcttccgttcttccgtcatatcgcggataatggtgacaacgccgcggatccgagacaaattataaagcgggcttgcaatcataacatagtaccggccgttgatttcaatttcatccgtctgttctttctccgtttcgaccacttttgcaagcaatgcggacagcccttcaggaagtggagcatcttttgcagcctggttatgataccagttttgaagaaacatctcagccggcgggttcatgattaaaatggcgccgtcccggttaaaggtcaaaacaccatcggccatgctgcttaaaatattccgcagctgctctttttcctgctttaaggcgtccatattaaatttaagctgtcgccccatcgtattaaaagcggtcgccagttccccgatttcatcacgggttaaaatcggcacctttttgtcaaaacgcccttttgccacttcaaaagccgcttcccgcattttatgcaatggcccgccaatcctttttgaaaggaagaaagcaaagccggtcgttaaaataatggcaatgcctgcaccgagcaaaatgatttttgtcgtttgccgcgtcatttcctgaagcacttccaatgactggtaaacaaataccgcgcccggttcttcccccttcacatgaagcgggacggccgtcacaatcacatgatggtacttattgcgggaagacccgccagaaggggttaactctttgctcactttcttcttttcgctaaacacttgggacagctgcttgtcctttaaaatcgacgcgtacggaatccctttgtatgatttggaaccggacggataaaagatatcatttttgcggtaaacgatcatgactttctcgttttggtccagaacgccgagggcaatttctttcccgatctttccgcttgggtgctcctccataatccccgagattttttgcgccgtattggacaaatcctgctcaatctgattgatatggtattcttcaaaaaacttgagcaacagtaccgtcaggatgagcagaacgcaggcaaccatcagcagaatggtcatccacagttttccgacaaccgtccgccaaattctcattccggcgcaacctcaaatttatacccgacgccccagacggtaacgatcattttagccgcgttttcgctcactttattcaatttttcccgcaagcgtttgacatgcgtatccaccgtacggagatcaccgaaaaattcataatgccatacttcttttaaaagttgttcgcggtcaaacactttatccggagatttggcgagaaaataaagcagctcatactctttcggggtcagattgacttcctttccgtccgctgtgacgcggtgagcatcattgtcgatggtaatatgcgggaaaacgacaatgtcttttgcttttgtatccgcgtttaagaaacccgtttgcagcgatcggcggagcagggctttcacccgcagtaccacttcgcgcgggctgaacggttttacaatataatcatccgcgccaacttcaaatccttccaccctgttggcttcttcgcctttagccgtcagcatgatcacgggcgtcattttcttttcgtgcaattcctggcacacttcaatgccgtctttgcccggcatcataatatcgagcaaaatgcagctgtagtctttttcaagcgccattttcaaagcggtatcgccgtcttccgcttcatctatcgtgtaattttccctttccaaatacattcgtaacaggcgccggatcctttcttcatcatcaaccactaaaatttttacatcctcatccattgctattcctcctcagtcaatatcagccgcctgctgcgagcaagattcatccagccggtaaaatccttgcgggcttcccgaggccatgcaagccgcccgcatccccgggtggggctcccggggatgcggaggattcaaaagcttacaaaatcaggcatacgaatgcagcccagcaatgacaagatttactgcaatcaggttaaacagaataatggcaaagccaatgacggccagccaggcggatttttcaccttgccagccttttgacatgcgcaaatggagaaaagcggcataaaacagccacgtaaccagtgcccacacttctttcgggtcccagctccaaaatttgctccaggcaatttgtgcccagatcatcgcaaagattaacgcgccgagcgtaaacaccggaaacccgatcaataccgaacggtagccgatctcatccattaaatccgcatttatatttttggtgagcggttttaacagcgcgccgatccgctttctggccgccaaccggaccagcacgtaaagaatgatgccgctcaaaacagaccagagcaccgtgttcagtttgacggcattgataaaggccggcacataaaaccacggcgtcattctcccagctgttaaaagttccccgccatgcggcccgataacagccggcatatggtagacgagggcattttcccccgtgttttttgccccgttgcggtcaatccagctgaaatccactttgtaatgaaacaagccgaaagcggattttgcaacaataaaaccggcgatgcagattaaacaaagcataacaaattccagccagaaagtctgccggtttgatttttgctgatcagtgcttttcacaaggtaaatcagcccggcagcaaaactgacagcaagaatggcctccccggcggccgccgttgtcacatgaatctgcagccagtagctcctgagagacggcacgagcggattgatgtctttcgggaacatgcttgcataggcaatcaaaagaagtgcaaccggcaaagcaaacagcccgagcaccgcactcctgtaaagaaaataaatgaccataaaggctccaacaagcatcataccaaaaaaagtagtgaattcaaataaattacttacaggggcatgcccggatgcgatccaccttgtaataaaataaccggcctggcaaataaaccccgcaaccgttgcgaagatcgcaaaatttccccacttcgttttttgcggcccagtgcttccctgtccctttttcggtgtgcggatcgcgccgccaaacagtaaagtgccgattaaatacaaaagaaatgcggcgaacaacaaccggctgctcgtttcgaccagattttccaattttccccctcctcatccgattgctcctgtctgtttaagccgtatgggcctgttgcggattcttccgttcttttctgtcaacaagcgccggcatgccggatgcgctgagcacccattccagctccctttttagcccgtaccagtttttatttgtatgggctgccaaaagcacggcgcctttctcccgcttcagccagaaacggcggtgattccagtacgcgccctgaatgaccccgatcataaagatcgcgcccccaacggccagtacccagagcgtctcgtcttttcttacggccaaagcagaaacattccgcgtttcaagcccggcaaaagccagcttgtagtcattttttccgagcggttccacagtctgacggatggcaacaaagcttttttcccctttcggatgctccggcgaaattaagctaaaaagaaaagcaggattgtttggaatatacgaatccgtttgcggctccccgtttttggcaaaccctgtaaacgaaggatagtagccgagcagcttgactttatagccgtttccgagcgggtactccgcctttggatggtacaggtcaattttaagtttgccgtatatttttttattcgacttcttctcaaaagcaaaagacatcgcctggaattcatccagcttgtaatccatttgatacacggcgtaatgtccgaatttcaaaggcttattgacctggatgcggtagaatttcacttttttaagcggggcgtcttcccctaaaacgcgctttttcccctgcttgtaaagcacggcatccgtctcgaaatttttcgcaacattgccgaccctattcagtgccgattcaaaattttgattgtcttttttgctgtaaacttgcagcttgaattgcttgttcaggagcacatactgcccgtttgtgccggggagcaccgctttttctccttccctcacccagaccagttcatcgacatacatgccgggaacaaagcggagcatagagccgcaaagaaagatgatcaatccgatatggttgacgtacggcccccagcgggaaaaccgatttttctcggcaaataagttcccgccttcttcgcggattttataatgtttcgcttcaagccggtgtttgacctgtgcataagcggcgtcatcgatggccccttcctttttcacgtacaggcgctgccgcttcagaaacccttcatggcgcgctgctttctggtttgagagggcgcggcgcagcgggataaagcggtcaaggctgcaaatgacgagcgaaacgccgatcagggcgatgaaaagcagataccaccaggaattgtacaggttatcaaatccgagcgtataccagagcttgccgaaccagccgtactgattctcgtaatactcggacgggtcgacattggaagggatatagtcggcctggggcagcacagtgccgagtgctgacgcaattaacgtcaggacaatcagccagacaccggtttttacggacgaaaaaaaattccagattttatccaccggcgtttttttatacacttgcgacctgcgcgcgcttccttcataccgcatatcatggaggactgccgcctccgcttctgctgtcagcgctttcccgcacgactcgcacaaaacggtcccgggaggattcacatgtccgcactcacattttatatccttcattgtctctctcctcggttatggtttgatcatatccatcatgtcctgaatgtcttttttggagaggttttggtttccaatgatcacttttttgactttcccgtccggcccgatcaaaaaggttgtcggaagggggtcgatgtgatacgcatgctggacatcaccgtttttatcaatcagcaccgggaacgtaagcccgtactgtttcacgaattcgtccacaagaaagcgcgtattttttacgtggacggcaagaatttccacgccttttggtttataggacgaatagagttcattcatataaggcatttctttcttgcacggctcgcaccatgtcccccaaaaattcaaaaggacacctttccctttataatcagataaccggtacgttttcccattcaaatctttcaggataaaatcaggggccttatcccccgctgcaagcgctccccgcgactccttcgtcgcatttgcatacagtgtgtaaccgacagccaataccaaaacagcgagaatcgcggcgcggaaaatgagacgtttctgtttcgtttgtgacattgctcctccccctgtccaaaagtgtcacacaactctcatacattataacatttttctgtcctttttcgctgttttttgaagtttttgtgaacaaaataagccccttaacttgcgcttttatttacgggaggcgccgccgttttcggcaagggatcttaacgtcttgacttcgtgcggggtgagctcccttttttcgcccgcgtttaatccttttaatgtcagcatgccgtatgcttcgcgccgcagtttttcaaccgggtagccgagatgttcgaacatgcgcctcacttgcctgtttctgccttcatggatcgtaagctggacgatcgctttcttttttcgtttgtccatggacaacagttttgccctggcaggcgcagtcatgccgtcctttagccggatccctttttccagctgctttaattcctgcctggatggaatgccggaaatccttgcaatatacgttttgtcgatttcaaaacgcggatgcatcagaaggtttgcaaattcaccgtcattggtgactactaaaaggcccgacgtgtcgtagtcgagccggccgaccggataaacccttgcacccgcatcgcggaaataatcgcttaccgtttttctccctttgtcatcgctgacagtggaaatcacccttcttggtttataaaaaaggtaatatactttttcttcacgctcaagcggaatgccttccacttcaattttatccgactgggatacttttgtccccagcgttctgactgtctccccgttcacttttactttcccttccagtatcagctgttccgcttttctccgggatgtgacaccggcctgtgcgatcactttttgcaaacgttccatccgttacacctcaatctgttttgcttaaactatcctttaagcattatggcataacgtaaataaaatgcaaagccggacgagcgaaacaagcaccctgaaatgacggagaaaccgttttttcttttaccgcgtcagaataacaacagcaccatgaaaatcgcaatcataatcccgaacagatcggcgagcagcccgacttttaaggcgtcccccattttccggatgccgactgccccgaaataaacggttacaacataaagggtggtatccgtgctgccctggatgacggatgccattctcccgatgagcgagtccggcccgtatgttttgatcagatccgccatcagggcaagagcggcattgccggaaaccggccggatcaaagcaagcggcacgacttcagatgggataccgagcaaatgcagggccggttttaaaaatccgacaaaaaaatcgagcgcccctgaggccctgaaaattgtgatcgagacaagcatgccaactaaaaaaggaatgatggaaaaggcaattttaatgccttctttgccgccttccacaaatgtttcgtaagccggcacttttttccatgcgctgtaaagcaggataaatccgaccattgccggaatcagccaaattgaaatcagtgagatccatttcaaaaacatcacttcctccgtttcgtccgccggtggtaaaaatagcggtcaatgcaaatggcggcaatggtcgttgcaaaagtggcgatgcaggtcggcgccacaatctcggtcggatgcgcggaacctgcattcaggcggatggcaatcaccgttgccggaataagtgtgagcccggatgtgtttaaagcaaggaacgtgatcattgaacggcttgcttccggtttccttccgttcagttcgtgcagctgctccatcgctttaatgccgagcggagtggcggcatttccgagcccaaacatattggcaatcatattggagaggatgtagccgagtgccggatggttgtccggcacatccggaaacaatttttttatcaccggccggaacaggcgggaaagtttcgaaaggaggcctgaaacttccgcaatcttcatcatcccgagccagaaaacaagaacgctgatcaggccgatgctgatcgagaccgcatcgcgcgcggatgtaaaaatcgcctcgttcaccgcctgcatcttgccatttaccgccgcaaaaacgagcccgatcacggccatgccgatccaaatataattaaccattgtttttcagccccaattggatccaaaatgtctctttgaactgttcaagccatgtttctttctctttaaccggcgttttctgataataaataggcgtgctcgcgatcaccttttcgtttaaataaacaatcgcccttccgacggtctccggcactttttccgggtctttccacgaattttcaggctttttgatccggtattcgacttttacggcgtcttcttctccggctttaagcgggtaggtgatatcccgtttcacataaacatgctgtttcaaatatttcgtgcggacggcggcaaccggcccctcttccacaatccgtttcctgtcatactggctgaagccgtactcatacatcgcaatatggtcatcccagtcatccgaatcgttcagggtaacggcgatgagattttcgccgccttttgccgccgttgtcacaagtgtccgtctggccgctttcgtataaccggttttcccgcccgtacagtaccggtacttttcagtcagcagccggtttttgttccgccagcctttgtaaaatttcgtgccggtaattttccggaactctttattttgcatcgcgtatttcattaacagcgccatatcgtaagcggtcgaataatggcggccacccgggtcttcaaggccgttcgggttagcaaaatgggtgtcatgcatgccgatctccttcgctttttcgttcatcataaaaacaaagccttctatgctgcccccgacattttcggcaatgacattggcggcgtcatttcccgaccggagcatgagcccgtaaacaagatccttcattttccatttgtctcccggtttcaaatacaatgatgacccctcggtacgtacggcgcggttcgaaacgacagcctccttgtccatttttcccgattcaatggccactagcgccgtcatgattttcgtaatcgaggcaatgcttctcggttcatatgcatctttttcgtacaaaatccgccctgtatcctggtccattaatatcgcgctttttgcctgcacagacggcgtatcagcagcagccgctccgggcggaagggccgaaaaaacaagcactgcaagcgccgcatataggaagtaccgtttcataaagaagctccttttttcagcttttccaaaccgcgttttgtacaagtttatgcacggaacaggaagaaataaccggaatatgtgtgagacgaaaaaagcctgcaccaatttgggcaagctttcttcacggcgaaaatccgttttcgcctttttcttcatggaatttttcaaaaaacagatctgcttcttcctgcgaaaattcgtcttccggctgttcgggaaacggcggcagttcttttaaacttttcagcccgaaatggtcaagaaattctttggtcgtaccgtaaaggattgcccgcccggcgccttcctgcctgccgacttcctggatgagcccttttgccatcagcgtctgcagcggcctttctgttttcacaccgcggatttcttcgatttcaattcttgtaatcggctgtttataggagatgatcgccagtgtttcaagtgccgcctgcgataatgtattcgtattcggggattcgaccagtttttttaaatacggcgcatgctcttttttggttgccaactggtacgtgccggccagttcaatgagcgtaatgccgcgatccgggtcgttttcatattgttcttttaaacgctttaaaatttcaactgcttcaaactcttcaatttccattacatgggaaatttgcttcagggaaagcccctcgtcccctgcaacaaacaacaggctttcgaggatgcctttccaatggacgatttccatatcaatccccctctttccttacaacggtaatgtcaccgaaattttcttcctgtaccgccataatttgatggcgcttaatcagttccaggacagccaaaaaagttacgacaatttgttctttatcgtgaaaagagaataagtcgtaaaattggacgcttcccggcgccgtttccagctgttttaaaatttcatccattctttcttcgatcgagatttcctgccgtgtgattttggtaaacagcggtttttgcaatttttttctgcgcaaaagtttatttaacgcgccgatcatatcatagatcgtcacattggcgccgatttttcttccatctgcgtccgacgcatacgccgacaaatcgctcggcggcttggtgaagatttcgctgcggccggcttcaaggcgtttgaacgtgctggctgcttccttgtattttttgtattcgaggaggcgctcgacaagttgttcgcgcgggtcttcttccaccgtataatcttcatccggttcatctggctcctgttttggcaaaagcattttgcttttgatcgccaaaagcgtggccgccatcacaagatattcgcttgcgacgtccagttcaagctctttcattgtatggatgtagtccaaatactgctcggtaatttcagcaaccggaatatcgtaaatgtcgatttcaagctggtggatcagatgcaaaagcagatcgagcggtccttcaaacgcgccgattttcaccttatattccataaaattgtacaccgttcctttttcaaagcgtcaaaataagtatagcctgaaacgtatgtatctccaatcaaaagcgcgcagatgggcaggagtccatacacgttccggcgcgcctacatagtataccatgtaatgactgttgagggaggggttatcatggctgacggttttggctggggcagcggatttgcgttaattgtcgtgctttttattttgttgatcattgtcggcagtgcgtatatctggtaaccgtaaaaaaggcctccggcatcatgccggcaggtcctttttgccgtatccgaaataaaagaagacccggtcaggacaggtcttctttttcagcacacttatggaagaagtcaacaatgtatttattcggaaccacttcttttccttcatacatttgttttaaagccttgaccatgcttttcccgattccttggtcgcgataagacggattgacggaaatatgctggatttccactttgtccccatccagtacaaccccgatcaggccaacaatgtcatcatcctctttccataaaaaaagctgccacttgtcttctgtttcgtacaattgctttgtttgctgcagctttttcaaatctttttcatctggcataaaggacaacaggcccattgcaatcttatcgaaagattttttataccgaattaacatactgaatccctcgtaatcatccaatttaattcaaacgctttacttattagtatattcctatttcagagaaagtaaacaaggcacgtacaatattttccaaaagcaagtccggaaaacaagtgccatccgcttttccgccccggatttgtcaagaaagcggcacgcgcagacggagatcattgcggatcaggtcttcgtacgtctcccgctttacgacaagctcatctttgccgttttcgacaaacacaaccggcgggcgtgggatccggttatagttatttgccatcgaataaccgtaagcgccagtgcaaaatacggccaaaaggtcatcgctgcctgtcttcggcagcggcagatcccaaatcagcatatcccccgactcgcagcatttcccggcaacggatacggtctcttcgcacttatcaagcggacggttggccagcactgcttcatattttgcgtcataaagtgccgggcggatattgtcgctcatccccccgtcaaccgcaatatattttctgacatgcggcacttccttgcgggacccgaccgaataaagcgtcgtcccggcttcgccgacaagcgagcggcccggttcgatccagatctcgggaaccggcaggcggcgggaaccggcctgtttcttcacttctttgacgatttcttctacataataagcaggcggaagcggatggtcttcttccgtatagcggatgccgaaaccaccgccaaggttaagcacttccggaaaataaccgtacctggcatgccactcgtccagtttatccataattttctgcacagccaggacaaagccggctgtttcaaaaatttgcgatccgatatggcaatgcaccccgagcaattttatccagccggatgaaagcacctgcttcagcgccgcctccgcctgcccgttttgcaagtcaaaaccgaattttgaatcttcctggcccgttaaaatataatcatgcgtatgggcttcaatgcccggtgtgacccttaagagcgcggaaactttgcggcctttttcagcgcacaagttttccagcatgtcaagctcgtaaaaattatcggcaacgatgcagccgattccggcatcaagcgccatttccaattcttcccggcttttattgttgccgtggaaatgaatgtgttcaacaggaaacccggcagcaagggcagtatacagttccccgcctgaaacaacatccaaagacagcccctcttcatctgcaagctggatcatggcaatggcggaaaaagccttgctggcataagcaacctgggatttgacgccgagtttccggaatgtttccttgaacgctctggccctttgccgtattaaagcaacgtcatatacataaagaggcgttccgtaacgggcagcgaggcttaccgtgtcaacaccgccgatttcgagatgcccctttccatttacctttaccgacccgttatgcttcatgttttcaaccccacctaatattccgccaatcgggagagaagccttcccggcataaaccggggtaggcttccctccctttcctagagcttttgcgttaattttctactaactttaacataaaaacaggctttctgcaatagtttcaagcttcaggcggctggcggaagcgatcgaccgggtggacaatgctcgggcggtacttggagcccggaaccggccttctgaacaggatttggaaaaatgcctgcgggttaaacgggataaacggccagaaatacggcgtgttcaacggccggatggacacgaggaacagcagaaaaacggtgctgccgatcacaaagcctttgactttaaaaattgctacgataatcagtaaaatcattctcacaagtttattcgccacgctcagctcataacttggtgtgacaaaagtgccaatcgccgcggcggatacatacaaaatgacttccgaaacaaacagcccggcttcaaccgcaatctgcccgaccaaaacggccgcaatcaagcccatggcggtggcgagcggcgtcggcgtatggatggcggcaacccgcataaactcaatgcctaaatcggcgataagaagctgaaggacaagcgggacatgcgactgcttattcggcccaatgtaatccagttgctccggcaaaagcgacggttccaccgccactaaataccaaagcggcaggagaaaaagagaaacggcaatcccgaaaaaccgcacccagcggataaacgtgccgacagctgcagcctggcggtattcttcggcgtgctgcatatggtgaaaaaccgttgtcggcataatcatcacgcttggtgaagtgtccaccaatacaagcacatgcccctccagcaaatgggtggccgcgacgtccgcccgttccgtatagcggatcagcgggaaaggattataattttgtttcaaaataaattcttctaccgttttatctgccatcgtaattccgtcaatatcaatcgccttcagttcttttctgaccgtttcgatgacttcgggatctgccacgccttcaatataagcaatcgatacatccgttttcgagcgttcgccaactttcatcatttcaaagcgcagccgctcatcgcggatccgccgccgcgtcaaggccgtattgataacaatattttcaacataaccgtcacgcgccccacggacgactttttccgtatccggttccatcggcgtccttcccggataactgcgaacatcgataataaatgcttcttgttttccttcgacataaatggcgatcagcccggacagcacttcatcgaccatttcatcataggttttgactttttcgacctgcatatggacgatgtaattttcaacaagctcatgcactttcccggaagaaaatttgccgttatttaatctcagcagttctctcataatttggataatcgaaatcgtttccgtgagcccgttgacatagtacagctggatttctgtatcaaggacctggatttttctgacaccaatatcataactgatgccaagtccgactttatttttaaaaaatgcttccacttctgccggattggatgaaatcagccttttcctgcctgtttcagccatgcttgaacccgctcctttccaagatcagtcgtaccgctttttctgtgatcggggcgccgatatgataatcgtcttttttcgacattttgccgacatccccgatgccgacaataatgggcacgtccagccggtcaagactgtaaaccgtgtccccgttgatttttttcaaatccatttccggaatgccgaatttgtccaccccgtacggcgtgatttcaccggtattgtcaatgcacacatccacccttgaccattcggcctgatgggttttcgatgcgaccgcaatcacgccgagcacttcgatgcgcggatgcccggccacaaaagtgagcgcctcttcgccgggtcccgggccgatcacccctgaatcatcgaacatggcaaaaacagggtctccggccgccttgaggatcaggtccgcgatctgctccccacaaagccgggttggatttccgtatgattgtgaaatacagcgcccgcccatttttttcgcgacgcattcgattgcttttttcgcatactcatccccgtccgtgacaaggatcacccgccgtttttcccccatgccggttgttcctttcttaatgatttacataataaagccattgaaataaagcgccagccaccttcccgagcacgatcgccatcaatgcgccggcaagacgcccgtccattccaattcttttggaaaaaattgggatgacattgaccacttctgtgagcgccgcagcaagcatgccgacaaacaggccgcaaaacaacccgacaggcgccgcaacgattgctgaaagccggccgcctgcgtcaccaagcccccaccatgtcccggacagcaccccgaatacaactgcccattcgtatgattggatgaaccgttctgtcctggacagctggacaagccgcggcacaatgccaagcaccgttaaaaaagccacatacccgcagccgaccacaagcccgccgccgagcccgcaaaacacggtgaagatttgcttaaggatggtcaaaatgtttcatgttctccttattctcattcaacaggatataatggtcgatgtcctgctgatagttgaaaatttcaacttcaagcgggctcggttcttcattaaatttctttttaaatgcatggttaaaaaaaattaccatacccgccccgaggccgagcgaatagggaatttgaaacataagcggcgtattgtcgcggatgcctgtaatcagataataaattttttcctgggcagcccgcatgccgacatcttcgtgaaaattgataatcccaagcgcagagcctaaaaaaagcaaaatccaaatcaatataaaaaacaaaagcggcaggtacctcttttttgcggctacttccacaatcgttgccgccggaccgaccggagacacggcagcgtccggaatctttttcttgatacaggaaataattttcatcatatcaatgacaacggtgttcccgtcggccttggaaatggtttggacgggggtgtccaaaagggtttcctgtataccggacggcgcgtgaatctgggcaatatgggataatcttacagtaaagcccggattgacgcgaatacggtggcggagccgcaaataaatcgtttcatccactgccttcaccccctgctttcatacgttgtgtttgtagtatgtgatattggaagattttcatgcaccggtttcatgctgtatgtatcgtatgatcaggcgattcgccggacttttgcacgcttcctgtgcttttttccattgccggatgattttcggcttctgttggacgccacatccgggaataaaaaaagcaaaaaagcgcacgtttacaactccatgcgctctttcattacttcaagtattttcttttcaagccgtgaaacctgcacttgcgaaatgccaagccgttcggccacttcggactgtgtctggtctttgtaatagcggaggtacacaatcagcctttcgcgctcctcaagccctctgatcgcttcctggagggcaatctggtcaaaccacttttggtcgttctggtctgaaatctggtcgagaagcgtgatcgggtcgccatcgttttcatataccgtctcatggatcgatgacggggctttgcctgcctcctgcgccatgacgacttcttcgaccggcatcccgagttctgatgcgatttcgtgcacggtcggcgatctccccagcttttttgttaactcatcgcgggttttgcggatccggttgcccgtttctttcaaagaacggcttactttcaccgtcccgtcatcgcgcaaaaaccgctggatttccccgatgatcatggggactgcataggtggaaaatttgacgtcatacgaaagatcaaatttatcgaccgattttaacagcccgatacagccgatttgaaataagtcatccggttcatatccgcgattcaaaaagcgctggacaaccgaccagacaaggcgcatatttttttcaacaatcaggtcgcgtgccccctggtccccttcctggctgcgcctgatcaggtttttcacttcctcatcttttaaccgggttttcttttctgcctttttcagttctgcatccatcggcacgactccttaattgcataaggcgtttttcaaggccaaatgcttttttagacgaatgatggtgcctgattctggctgcgacttgatttctacatcgtccataaagttttccatgatcgtaaagcccattccggatctttccaggtcaggctttgttgtaaatagcggctgcctggcttcttcaatatccgctatgccttttccttcatcgcggacggtaatttcaaccgtgccgtcgtcataaatggcagccgatacataaaccattccgtccgggttttcttcatatccgtgaataatcgcgtttgttaccgcttcggatacgaccgttttgatttcggtcaattcatcaagcgtcgggtcaagctgggcaacaaaagcggcaaccgccacgcgggcgaaagattcattccggctgagcgcggaaaactgcaattgcattttatttttcattcaggcaacccccaatctgtgcagcgcgtattgttccgattcatcaaggcggatgattttaaagaggccggacagttcaaacagcctttttacggccggagaaatggcgcagacgatcatttccccgtttttctgcttgatctgtttgtatcttcccaatatcacacctaaaccggagctatccataaaggaaagctgctccagatttaatacaagatggcggatgccgttttcttcaattgcttttgtcacacttgcacgcaaactttcagccgtatgatggtccaattccccctgcagccggatgcacaggacatcttttttcacttccaggtcaattgccagactcacaattaaagcctccttcgctgttaatagtgagtcatttcgaccttgcttcccgtttttccttccgggagacaaaagaagctttaaaaaaacagaaaccaagcggattcgacatcaatctttctggacaaacatgcccgctgcacgtttaaacagctgccaccagcctgcacgtttcaccgttttgtcggcaacaagcgttgtttttgaaagcacctttccgtcttggctgatagtcagtgttccaatttcatcgcctttttggacaggggcctgcacattttttttgagcttcacagtttttttcaaatttgacaatttgacgccttttttcgtcagcaccgataccggttcgctcgtcaccgcccggacatgccgcatgctcccttttgacactttgacctggtcaagcgccgcgccttttttgtacagcgggtgggaggtatactggctgaacgcatagtcaagcatttttgaaacctgggcgttccgcacttttgttgatggcgccccgaaaacgacggcgatcacacgcatgccgtttttctttgccgttgcggtcaggcagaattttgcttcatttgtaaagccggttttcaggccgtcaacgccgggataatggcggaccagtttattggtattgacgagccagaactttttatcggagccttcccttaagtaatcttcatatttgccggtgaaatgggtaatgccgtgatgtttcagcaattgcttcgccatgatggccatgtcataagctgaactgtagtgacctttgacagggagcccggtcacattttcaaaatgggtgtttttcaaaccgagcgcttttgcccgctcattcattttgtcgacaaaagcttcttcgcttccgccaattctttccgccatcgcaacggccgcgtcatttgccgaaccgatcgcaatccctttcagcatttgttccaccgtcatttcttcgccgggctcgagaaaaatttgcgatccgcccatggatgccgcatactcactcgtccgtactttttcatccattttgatttcgcctttgtcgagcgcttccataattaaaagcatggtcatgattttcgtcatggaagcaggcggcaattcttcatggctgttcttgctgtacagcacttcgcccgtggcctgttcaattaaaatggcggatttcgcttccggcgccagttcatttttcttttcagctgcgaacgcttcaggcacaaggacgccggctgcaagcatgaagcaggtaaccaaaccaatgattttcttcatgatgaccctccaacttgtaaaatcataaaacgtgaaaacaaaacctccgtacacgctgggagatatgcataaaatcattttttccagttgcgccatttttatactggataaattccctttcttctaatccgcgggatgccggctgccagacaaataaaaaacgcacggtttttacgccgtgcgccttaaaaatctgtttttagttttgtccttataattcccggaaacagggtgctgccaaacccgcctcgcccggaaaaaagcatgcggccgggtttaagcccttggatggaatttcgcataaacatcctttaacctcgttttggaaacatgggtgtaaatttgcgttgtggaaatgtcggcatggccgagcatttcctggaccgcccgcaagtctgccccgttttcaatcagatgagtggcaaatgaatgcctcagtgtgtgcggggtaatgtctttctcaatattggcttttttcgcaagcgcctttaatattttccaaaagccttgccgtgagagacgggcgccgtgatggttcaaaaacaaggcatccgttctattcgtttttgaaaccagtttgggccgcccttcttttaaataccggtcgagcgcagccgacgccgtgcgaccgatcgggataatcctttccttgtccccttttccgatacatttaataaatcccattgataaatgcagatcgtcaagattaaggccggtcatctcactgacgcgcatgccggttgcatacaacagttcaagcatcgcaccatcccgcatatgaagaggggtatccccttttggcgcagcaaggagcgcttccacttcctgaacgctcagcactttcggaagcgtccgctcaggcttcggggtttcaatatggacagtcggatcctggcccgcaaatttttcccgcaacaaaaactgatgaaaagaccggatggaggcgacatgcctggcaatcgtcttcgaggactttccctgctgttttaaaaagttcagaaagtggaggatgtgaaaccgcgtcacttcattccaagatgtaacaagctccactttttgcaggtagcggagataactgtgcagatcgcgtttataggacgcgatcgtattttcagcgagccctttttcaacgatcataaaatgcatgaaatctttgatttgatcttccattccaattactccccatccatataaaagagcagcagccgttctgcccaagcaggcttatggtccccggcactcacctttacagccgcgccttttggtttttcataacggtggtagctttcatattcctgattcacccaaagcagggcaaagtagaacaacaatgtgcagcataaaaataaaatgaagactttaagcgcatgaagcaaaagtttcagccacggcatatcccgcccgcctttctgtatcgctttacatacaagctatgacagacttccgccgttttatacatccttttatgtaaaaattcaaccggctgaaaatgcggtgttataacaaaaaccttttcgtcttgcgaaaaggccggttatttttcgttttttccgttttcgtttcccttttctttttgctggcaccggtaacaaatcccgtgaaatgtcaggcgatggtctttgataataaaattccagcggctttccacaactttttcgacattttccagtaaatcttcctgaatttcgtccaccgcgccgcattcaatgcagacaagatgatggtgaaaatgtgcggcgccttcctgcctcaaatcataacggtacaccccgtcgccgaaattgattttgtccaccactttcagttcggacagcagttccagcgtgcgataaacggtggccagaccgatttcaggggatttttctttcacaaggaggtatacatcttccgcacttaaatggtctgtttcatgttccagcaaaacgcgcacggttgcttcccgttgcggcgtcagtttgtagctggccgaatgcaattgcttcttaattctatcaatacgagcttcttccatgattcctcccccttgccgctgtctctgatattatagcagattaaggggaatagtcaaaatgaaatgattataaacagttaaaaacaacatttattatttaagaatgattttaatggatcatcttcatcacggcctgcatcagctgcggagaaagataagcctcgatgcaggcggccgcgagagatgcgatgaaaacagcgagaagcgccgtgcaataccttaaaaacaattgaaaaaaagcaaagtgggcagcctgtttcataaaaattttccggatcaggttcaaggaaaacatgacagccatcaccgaggtgaaaataaacaaaggaatgatcagcaaattttgcggaagaacggttacaaacgaaagcaaaaaaccgccccatttcatctggttgacaagaaaaccgatcgaaaacccgacgacaagcccctttaaaaataagagaacaagaatgagcggcaggccgatgatcgaaataccgagcagccagatgaggccgagaaatttcaaattgtgcaggaaacttgaacggaacaggtcctcaggcgcggcgagtttgccggttgagacttgtccgaaaaattgctttaagtaaaaaaacaagtcttctttctgtgcgatcgacaggctgttgacgatgacggcgccaaaaatgacgcccatcaggaacaacgcgatgacaaatgcataaatagaggagttttcccggatatggcggctgacaggattttgcagggcaatttgcttcatgagcggtgtcccctccttcaaaagattggcacttgctattaatctatgaaaggacatagccgcttatgaaaaaagtccaaaaccggagcgaaactattccggctttggattttttaccttgccatattttccgcccccgccggcctcaaacgccaatcccccggaacgctgtttcaagatcagttccgaaagcggcggttttacaacgcttttcagggcggattcgggcgcccggtgcaaaatattcatctccgtcccgaaatggtccagcagcttgcccatcgttttcgggccgagccccggcaaaaaatcaagcggcacctggtggatgtagggtggccgggcaggatgcgtttttgcgtctgtcagctcttctattctttccgagacaccttttgttttcaggcgcgacccgcaatgcgggcatgggccgtttgaaacagggttccggcatttggcgcaagtcgttgtataatatttcccaagtttcgggtttaagccgtaattggcggcaatccggttttccccttcgccgcgcaaagcttttaacagccctgtaaaccccggcgtttccagcatcaatttttggtattcccttgccattttgccgagggaatgggcgtctgaattggtcacgaacggatagcggtgcagctcactgatgttatcagccatggtggtatcagaacttaatcccaattccacagcatctatcagatccgggtccagcacttctgttagcgaccgttccacaccttttccataaaggctcttaaagggggtaaatacatgggcgggaataaacagcccggagagttctttcgttttttcctgcactttccgggcctctgcgcggacccgctgtgtgcttaaatgtggattggacacgcgcccgccataccatgcggaaaacttgccgagtgtgtccatatccggaaaatagctgagcagatggaccggcccacggcagttttcatcatacacttccatttcaatcccgggaatcagcgtgacttccccctggtagaggaggccgccttcatcaagctgcaccagttcaccggctgcaagaagcgccttcatctcttccctgacttccgggacatggcagtcgatcaccccgacgagatcgagccctttcggctgtttggccgcctttaatatattttcaagcgtcaggctttttgcccccgtaattttgacgggccgccccgtttttgtgcgcccgatgtggatgtgtaaatctgcaaagtacggattgacactcattttcgcgcctcttcaagcatccagtgctggagggcaaccaatgttttggcgtcgcatattttccccgaccggatcatttccctgacttcatccatgcccagttccaaaatatcgacaaattcatcatcatcgcccgcttttggattggaaagtttttcaaggccggttccggcataaagatggatatattcatccgcaaagcccggtgaagtataaaaagcggttaccggttctaatttcgcgcaggcataaccggtttcttcctccagttcgcgttttgccgcttcaagcgggtcttcccccggctcgagctttcccgccggaatttcaatgagcgcgcgttcagccgctttccggtattgttccaccatcaccactttatgctcatttgtaaccgcaagcacacagacggcgccggggtgcttgatgacctcgcgtttcgacgtttttccgtccggcagttcaacctccaagacttgcacgtgcaaaattttgccgttgaaaatttcttccgtcttcaatgttttctcttcgtatttatatttatgcatgttacccggctccttttgttcttcacctgaaactaacacatatattttaccataaaaaacagactgttccgggagggaaagcttgatgatcatcatcgtccatccgaaaggcatcctcatgaagggaaaagcatgggaaattcgcgaccggctgaaaacatactgtaaaaaatacgaaacggtcgccgaatgggttgcaaaaacaacttcctcataagggggctgtctccatatttgtattttttcctgccccttctatacaataaaaaaaaggaggcagaaaaacatggaaaaaaaccggttgggaaattcagatttatatgtttcaaagctcgggctcggctgcatgtcgctcggtacggatccgaaaaaagcacgggtcgtcattgaagccgcacttgaagcaggcattaactattttgacacggccgatctttatgaccacggagtgaatgaaaaactggtcggcgaagcgctcaaacatgtgcgcggcgaagtgatcattgccacaaaagccggaaaccgctggaatgaagacggcaaaacgtggcgctgggatgcttccaaagcttacataaaagaagcggcaaaacaaagcctgaaacgactcggcacggactatatcgatttgtaccagctgcacggcggcacgatcgaagacccgatagacgaaacgatcgaagcgtttgaggaattaaaggcagaaggcatcatccgcgcttacggcatttcttccatccgcccgaacgtgatccgcgaatatgtgaaaaagtcatccattgcaagcgtcatgatgcagtacagcctgcttgaccggcggccggaagagaccatcacgacgcttttaggcgaaaacggcatcagcattgtcgcaagaggcccggtcgcaaaagggattttaagcgggctgccggaaaagattccagcagacggttatcttgataccggttatgaagaaattgtcgcccttcttgagaaaatcaaaaatacgcttttaaccggcgggcggacgatgcttgaacttgcacttcaatatgatctcgcctgccctccagttgccgccgtggttgccggcgccagttccccggaccaggtgcgcgccaatgcaaaagccgtaaacgctgcgccacttacaccggaggagcaccggcttctgcgcgagctcaccaaacaaaaccgatacgaagcgcatcggtaatctgttttcagcaaagaatgcaccgcgttctttgcttttttgtttattttttcaccttgttccaacagccctttcccggttatgccggaaaccatcccgttttcccccgtgcaaaggaaggatttaaacggcaaatggaaatcagggcgtaatcaatcgtacaggcagttgtgtcaaggcgactgcctgtgccattgccatctttttagcctttatatcgtttccagtccaaatcggattcttccagcagttccgcaaacgatttgttccgctcgcgctgcttccgttcttctctttttcgttcttcttccgccctctttttttctacttccactgccgcaagttcctgctttgcctgtttcaatttttcgagcacatctttttgcagcgcatccttcagctgcactttctcatcctgttttcctttttgttgtgcctgtctcttttttgccatttgctgccgtttgcaaaaagcccgcatgcctcgagtgcagccgggggcatcttacaaacggccttcaccgcccttcttctatcatcttttttcattataatatatttaccaatgcttcatcatccctcaggaggtccgttcatgagcgacccggctcccagactgaaaaatattttccggaagctgctttctctctttaaatccatgcgcgatctctggtatagtagcgttaaagaagaaatttgcaaggttttcgaatcttttcagggctgcttttcgtataagacgtatggccgaatcaaccaagatcgtgatcaggggtgtcgattatgaaattttttatgggtacggtgattcgcaccgtgataaccatttctagcgttatccttctctttctcgtcatttatttttcatccggccatctgttctggctgtcgcttttgctttcgcttgtcggcggctttctgatcaaccggcttgtgaagtggcaaatgttgcggggttttctgaaagcgcagcagctaacgcggaaagattatcaatatatccggaaaaacctgaaagaagcggacgaaaaaatcaggcgattgcaaaaaacctttttatccgttcgttccattagcacgttcaaacttttttacgatatgaataaagtaatcaggaaaatacaggcactggtcaaaagagagccgaaacgtttctatcaggctgaatctttttatttttaccatttggattccatgacggagcttgcggaaaaatatgccctcctgcaatcccagcctgtaaaaaacaaagaaatggccgtgcaaatccgggaaacggaagaaacgttaaaacaattgggacgcgaaacagagaaagatctgtaccatatgctgtcaacggatatggatgagctcgattacgaactggcatacgccaggcacaccatcgaacgcaaatccccttcccggcatgaaaggagtgcaaaaaaatgaacgcagacaaagaactttggcaggaaccaacaggcggcgggctggatgatctgcttgccgatccgttcggcacgcgtgacgccatgctgccggatgagggacagaaagcggagcctgtcactgaaacgaaaccatcacgccttgtggacatgctgccggaggaaaaccggcaaaaagcatacgaactcgcaaagcaaattgacccttcaaaccaccaggccgtcattttatatggcacacaggcgcaatcgaagctgctaaatttctcacatgccatgcttgaccaagtccagaaaaaagatatcggggaaatcggcgatattttaaatgatttgatgaaaaaacttgagcaggtgaatcccgaagaacttgtcccagaaaagaaaaacttcttttcccgcatgttcggcaaaatttccaattcggtgcaggaactgctttcaaaataccagaaaacaagcgcgcagatcgatcgcatcagcgtgaagctcgatctctcgaaaaagacgttgctgaaagatatccagctgctcgaacagctgtatgaaaaaaacaaagattatttccatgcgcttaatatttatattgcagccggcgagcttaagcttgaggaactgaacacaaaaacgattcctgaaatgaggaaaaaagcagaagcaaccggcgaccagatggccttccaggaagtcaacgacatgatccagtttgccgaccggcttgaaaaacggctgcacgacttaaaattaagccggcaaatcacgatccaaagcgcgccgcaaatccgactgattcaaaacacaaatcagacgctggctgaaaaaatccagtcctctattatgacggcgatcccgctatggaaaaaccagatcgcgattgccctgacgctcatccgccagcgccatgcggtcgaagcgcaaaaacaagtgtccaaaacgaccaatgaacttctgttgcgcaatgccgaaatgctgaaatcgaacacgatcgaaacggcgcaggaaaatgagcgcggccttgtcgacattgaaacgttgaaaaaaacgcaggaaagcctgatttcaacgctcgaagaaacgctgcgcatccagcaggaaggaagagcccggcggttccaggccgaacaggaactggcgacgatggaaaacgaactgaaacaaaaactaatgaacttgaaaggaccggggccggatgccggggcgtcctgaccaaaacgggcaaaacggcaacagaccgggccggcggacggaaagcctgctgccgctttcaaacaaagatccatccggaaaagcggcaggagcctgaaaataaaaccggcgcaaccggaaacttgcgccggttttttctttccgcttattaaagcgcatccggcatccttttttacttcaacatgcggagggattttgatgaaaaaatggttttccctgcccgccacggcggcggcgcttgctgcaggcgggctcggcttttacatgtcagagcgggtgatgcatatccgaaaaaaagacgacagcctcgtcataagccgagaagtggccgcgaaaaggctggatcttaaagcgtacgaatcattgccgaaagaggaagttttgattccgtccccattcggttacaagctcaaatcggtttttgtgaaaccgttccccgagtcgaaaaaatggatgattttttgccatggcgtgacggaaaacaaaatgaattccgttaaatatatgaacctgttcctgaagcggggctttaacgctgtcctctacgaccaccgccgccacggggaatccggcggcagtacaacgagctacgggtactatgaaaagcatgacttaaaagcggtggtggatgaacttctcaggcgcgaaggggacggcatctttttcgggattcacggcgaatcaatgggcgccgccacgctcctgctgtatgccggcgagctttgcggccgcgccgatttttacatcgccgactgcccgttttcctcgttccgggcgcaattgatccgggaatttacgcgggaaacgcggctgcccggaaaatggttttttccgcttgccgatttttttgtccgcatccgcgacggctactcgctccgccgtgtgtcgccgattgatgtagtcggccggatcaaacagccggtcctctttatccacagcgccaaggacgactacattctgcccgggatgaccaaagcgctttatgaaaagaaaaaagggccgaaacagctgtttattgccgaaaacggcgcccacgcccagtcgctcaacttaaaccgcgaacagtatgaacaggtgattgacgaatttcttgaaaaaatggcggcgtcccgtaagctttaatgccattttttgcgaacgtccgcccatgttgctgaatatggtataggagcctatcaaaacagggagtgtccatgatggaaatctataccgtacagcaaggcgataccctttggcggattgcaaaccgcctcgatgccgatcttgcccagctctttttggcaaacgggctaactgcatcatccccgctcgtccccggccaggcgcttgtcattcctgaccggttctttcagtacatcgtccaggaaggggaccagctcggcacaatcgccgcacgcctcggcgttttggcccaagcgcttataaacgccaaccagctccgcaatcccgcctcgctttttccggggcaggtgctttttatcccctaccggaaccatacggtaaaacagggtgaaactttgtacggcattgtccgtacttacggggcggacatgggggccattatgcaggcgaaccggcttcccggcacggctctttccgccggccaggtgctgcgtatacccgcaccccgccgccctgtgaaagaagtcaatgcctatacaaccgggttcggcgctgcgggcaccgctgaagtttaccagcttgggccttattttacgtacttgtcccctttccgtcatacgttccgtgaagatggcagcctgacgccgctcaacgaccgctccgtccttcaggcagcggaagcaaacggtgtccttccgcttttaatcctggccaatttcacctcggaaggattcagctccgatctggctgcccggctgcttcgcaatgaagcattgcaggaaactttgatcagcaatcttctcgccacgatacggcaaaaagggtaccggggcgtcaattttgattttgaatatgtgtatccggaagaccgcgaccgttatacggcgtttctcaggcgcgtcgcccgccggttccgcccggaaggcctgctcgtctcgactgcgcttgcgccgaaaatttccggcacgcagccgggcctgctttacgaagcccacgattacggcgcacacggggccatcgttgattttgtcattttgatgacgtatgaatggggatgggccggcggcaggccgcgggccatcgccccgattcctgaagtgaggcgtgtccttgattatgccgttaccgtcattccgcggaataagattatgatgggggcgccgctttacggacgtgactggagaatcccgtggcgcgcaggcacaacggcgcgcacgatcagcccgcatgaagccctttccttggcggcacggtacggggctgacatccgctaccacccgaccgaccaggcgccttatttccgttacactgatgcatcaggccagcagcatgaagtctggtttgaagatgcgcgcagcatgcgggcaaaaatcaatttgctaaacgaatacgggctgcgcggaatcagctactgggtgctcggcaacccgtttcccgaaaactgggtcgtgcagcaggcactcattcaggcaagaaaacggtaatccgcaacaaagcgtacggatgccctaagattgatttcatgaatgctgcttcttgctgcaacaggatgcgtccaaaccgccagtgctgcatttttctgcatcgcccgtacgaaaatccatccggcaggctttttcaggcttgccggtttttcatgcccgttccacttctgtcaccgcggaaagtttgatcgatatccgctcccctgtctcccctgccagctccagctttttttcgagcggccggaattttgtaatggtaccggtggcggtaaagaaatttcccgcttcaaagaaacggaccgtaaccggcacgcgcagccggcaggcagatatgagcatatggttcatctcttcaagctgctgctcatcgagttcgggctttgcctgtttttcctgttctttctgccattttaaaagtgcctgcttatgctcgggcaaaaacatgcgtgacccttcccaaagtttgttaccgcgctgcaggtatccgctcatttgtaatgccctcctatctttttggcacgttcaagcgcctggccggcatcaagcagcgacacggcgcggatgacggcgccggaaccgtatttctgcttgatgcggtcgaccgcatacccaatctttctttccccttccctgttttcaaacagatcaagctgccggatatcatcccgcgacaggcgcgacagcccgacgctgatacggcggaccggatttccgtcccaaaacgaaagaaacagccggcacgccgcccggtaaacgtccattgtcccgtttgtcggcgccagaagcgtcatctggcggtgaaagccggacggatgggcataatccgccccctggcagccgaccgaaacacaagcgcccatgacgcctgaagtacgcgcccggaaacagacttcctcgcaaagttcaagaagggcaactttgatttcatgctcaaaatcggcgtagtcgcgcggcagcgtcatcgcatgcccgatcgctttctgtccgacgtgcgattctttcgagacgggcgactcatcaatgccgtttgccgtctcccacagtacctggccgccaatcccccaccgtttttttaaaacagaaagtggaaagcaggcaagcgcaccgattgtataaatgccgagccgcttcagatgctgctccatccggctgccgacaccgaacatcctgccaaccggcaaaggccataaatgcgttttgagatgatggtgatccagttcaaaaatgccggttttgtttttcttcgcaaaatggtcgcacgccattttggccagcactttgttcggcccgatcccgcagcgggcatacacgccggtttcttccatgatgtcccgctggatttgcgcggcgatctcgcgcggctctccgaacagtcgcctgctgcccgttacatccatgaactgctcgtcaacggaatacggttcaaccatatccgtatagcgggcaagaatcgaagaaatctgcaccgatacatcgagatagcgctgcatgcgcggccgaacaataacggcatccgggcagagctgctgcgcttcccacaggcggagcgcattcttcacgccgcgctttttcgcgagcgggcaggcagcgagcaccaccccggaccggcgcgccggatcccccgatacgattacgggtttatccctgtacgccggatgatcggctttttccacacttgcataaaaagactgcatatcgacgagaaaaatcacacgctggctcatctttcaacccctcttaccttagaaactaagcaaacaacacgaactatagttcttattctattcctcattataaacgaatatacgttctttcgccaattgtttttttaggcagaggggttatatttttccaaaacgcgcatcacaccggctgctattttttaaagaaagcctgccgtccgagcctttccacaagcccggggaaaagcgcatggatggtagcggatgcattcatccattttggcgcattgatttcacgccgatttacaagcatcgtatccgttattttttctgcaagtttttcgggatccagcatccatttttcaatatttttccggtaggtgccggaccggtcggcgatgtcgaaaaaaccggttgcaaccgggccgggatgaacggctgtcacatagacgccaaagcgcgccatttccatgcggaggctgtccgtaaagccgcgcactgcaaacttgctggccgcatagacgcttgattttggggtcgccattttggccgcctgggaagcgatattgataatatggccggcacggtttttttgcatatgcgggacgaccgctttggtgcaggcaatgagcccgatgacattgacatcaaacatccccctgacatcctccatgcggatatcctgcacttcatcaaaaacgccgaaaccggcattgttcacgagcacatcaatctggccacagcggttgtaaatcgattcaaaaacagcaggaattttgccgtgctccgctacatcgcagcgaacggtcagacacgaaacctggtaagctgcttcgatctccgccttgattttttcaagcttgccgaggcttctggcgagcagaacaaggttagcctcgtttttggcggcggcaaaggcgattttttccccgaggccgccggaagcgccggtaatcacgatcgttttcttccggatccgtttatttgccatgtttccatcttctccctctatcttgaaaattttcattcctccactggtgccatttgccgcggcatggatgcctattctgaaaaatggtgccggccgattttcatgcttcctcccgtgccgcgttcattgcggcagcacgcctggtaccattttaaaatggccgggcacggattttttatctgaaaattcacggaatcactcttgacaactccccgatttttcttcataataagtaataccattttgataagcgaccggctgtgaccaggaccagtaagccgggcatgatgcaagagagcggggttctcaggctggaaaactccgccatccgctgcccggccgaacctgcctgtgagctgtttggcaaaaccaaaccggatgaaaaccgttaaccaaatgaggtgtaggatcgaattcctgcaataaaggtggtaccgcggaacatgccctttcgtcctttacggatgaaggggttttttactttgaagggaggcatttgcatgaaaatatcatttattggcgccgggtccatggctgaagcgatgatcattggcatgcttgaaaaaagaatcgtaaaagcctgggacatccgcgcccataaccgcacgaacaagaaaaggctccgcacattggaacagaaatacggcatccgggctgcagacggcctcgaccagcttttcgaaggcccggacgcggtcatcttagccgtaaaaccgaaagatgccccagatgtgctcgaatcggtccgtccgctcatatctccggacaccctgctcgtttcggtagcggccggcatcaccattccgtttatcgaaaacaagattggccggcatattcccgttgcgcgcgcaatgccgaacacatcggcgaaagtcgggctgtcggcaaccggcattgcctttaacgccgctgcgacaaaacagcaccggcaccgggcgtttgccatattttcggctgtcggcatgactacggccgtaaaagaagaacagctcgatgctgtaacagggctttcgggaagcggaccggcgtatatttattatatcgccgaagcgctccagcagtcagctgcagaaatcgggctcgacgcacaaacggcaaaacaatttatcctccagacgatcatcggcgcagcagaaatgctgaaaacttcagccgaaccgccggaagcgctccggaaagctgtcacaagcccgaacggcaccacagaagccgcgatccgcgtccttgacgaacgcgaggtcaaacaagctttcattgactgtgtaaaagcagctgcaaagcgagcaaatgagttatcgaacgcagggaaagaacccgcaagagaataaccggcaataaaaaagcggcaggcaagccgctttttttgctttacaaaacaggcacttccatcaaatcatggacaagcagactgtccgggaataaagcttgcgcttcctgctcaagcgccggccagtcttcttttccgtacctggcactaatatgggtaagaagcagccgttttgcccccgcctgctttgccgtttgcgccgcgtccgccgttgtcgaatgaaaataatcatgcgccatttgcccgctctccttgttaaacgttgcttcgtgaacgagaagatcggcattggctgcgagccggatttccgcctcattcggccttgtatcgccaaggatggcaatgatcttcccctttttcgccgggccgagataatcttttccgctgatcacgcgaccgtcttccaatgttaccgtccggccttctttcagcagccggtaaaccgggcccgggcggatcccttcttttttcaatcgatccgcatccagcgcgcccggtttgtctttttcggtaatccggtagccgaagctttcgatcccatgatcaagccgcagcgcacaaaccgtaaagcggtcgtcttcaaataccgttccttcttcaatttcgatgatctccaaaggatatttcagacgggtttcgctcactttcagggaaacttccacaaacgcttttatgcctttcgggccgtaaacggtaagcgggccatccccgccctggaacgaccggctcccaagaaagccgggaagcccgaaaatatggtcgccgtgcaagtgggtgataaaaattttttcaactttgcgcggtttgatcgcagtgtgcaaaatctggtgctgtgtcgcttccccacagtcaaaaagccagatggcatttcgttcttccagcaatttgagcgcaatggacgtgacgtttcttgctttggcaggtacgcccgcgccagttcccaaaaataaaatttccaaatgatgttcccccctttcctgccggatcccggccgcacatatagaactatcttatcataattttacggaaaggaaactattgcatatcatttgcgtatttgcccgtgaaagtctagaatatagtgacaatgaaatggggccggaaagcggaaaaaaatgatttttccctgcttttgaaatgaaatggctgcaacaaggcaaactataaccgtatcatgagacaggccggccttaaatcgtgattttttgaacaaagagaggtaagaaagatgcagacaactgagacaccgaaatcgttatttatgctttttggcgcaacaggtgatctggcgaagcgtaagctgtttccttccctgtacaatttgtaccggaaaggcaggctgtcagagcatttcgctgtgatcggcacggcaagaagggaatggacggacgaaatcttccgtgcgcatataaaagattccgttctgagcgcgagagaacatgcggaacagcttgaagcgtttgccgctcatttttactatcagccgcatgatgtgacagacagcaactcgtacatacagttgaagcaattagcggatgaactggatgaaaagtaccagctggaaggcaaccggatcttctatttggcgatggccccggaatatttcgggacgatttcggaccatctgaaaagtgacgggcttaccgctacaaacgggtttaaacggcttgtcatcgaaaaacctttcgggcatagcctcgaatcagcgaaacagctgaacagccagatccggaaatctttttcagaagaccagatttaccgaatcgaccattatttaggtaaagcgatggtacaaaatatcgaggtcatccggtttgccaacgccctgttcgagccgctttggaacaatcgttatatttccaacatccagattacatcaagcgagatgcttggcgtggaagaacgggcgcggtattacgaagcgagcggggcgctcagggatatggtgcaaaaccatatgctgcaaatggtggcgctccttgcaatggaaccgccgatcagcctgacaacaaacgaaatccggagcgaaaaagtgcgggtgctgcgtgccttgcgcaccattgaaggaaaagatgtgccggcatacttcgtgcgcggccagtacggtccgggcgaaattggcggcaaaaaagtccagggttaccgggaagagctgaatgtagcgccggattccaggaccgaaacgtttgtcgccgggaaactgatgattgataatttcagatgggcgggcgtgccgttttacatccgcaccggcaaacggatggcggcgaaatcgacgaaaattgtcgtgcagtttaaagatatcccgatgaatttgtactacaatacaaatcatgaactgaacccgaatctgcttgtcatccatatccagccggaagaagggatttcgcttcatctgaacgccaaaaaaccgggccagcatatggaaaccacccctgtgcagctcagctttgcaagcagcagcaaaaacggcattaatacgcccgaagcttatgaaaaattgattcatgactgtttgatgggcgacgcaaccaactttacccattgggatgaagtcgccttatcgtggagctttgtcgataatatttcaaaagtgtgggaaaacaagccgattacattcccaaattacaaatccggttcgatgggaccgaaagcagccgatgaactgctggaaaaagacggcttcttctggtggccggtggaagatctggaagttgggaactgctgaacctgttaaaaaaggaacacgccatctttgcgcgtgttccttttttatgggacgtgccggaagccggtaattaaccgcggggatccggcggccgctttcccgcttctctcccggtttggataatctgctccccaaatttcttgcggagccggctgattgcctcatacagcggctcttttttggctgcttcttcatatgaaaacagactcagctgttctgcttccgccttccggtccgttaaaccggaggcggtaatgcccaaaaggcgtacgggctgcccgttccagttccggataaaaagcgtgcgggcggcttgaaacaacgcatcgccgctttcaaccggccctccgctttttttgctcctcgtcaccgttttccggtccgcgtaacggatcatgatgcccacattggttgccgcaacctccttttttctcatccgttccgccgtttcatccgcaagctttttcagcacggcatcgatccggtgttcatcctccgtatcctcagatagcgtcaccatccgcccaacgcttttggtgacgtttacggattcgggatcaacaggacgcgggtctcttccattcgccctttctttcaaacggatgccacggatgccgagaagctgctttaaaagaaaatcatccgcatgcgccagatcgccgatcgtaaaaagaccacagccgttaagcttttccgccgttttgccgcctacaccgtgcatctcgatcaacggccgcggccataataaacggggaatatcccgctttcttaaaatggtgatgcccatcggctttttcatatccgacgctgttttcgccaaaaatttattcggggcgatcccgatgcttgacggcaaatcgagttccgcaagaatttgctgctggatcgattcggcaatggcaggcggcgtccccagttcctcgaggccggtaatgtccacataaccttcatcgatcgaaaccggttcgaccaaaggcgaatacgcgcggaggattgaaaacattttggcggatgcttttttatatagatcaaaacggggtggcacgattaaaagatccgggcagcgtttttttgcttcccagaccggcatggtcgtttttacaccgaattttctcgcttcataactgcacgtcacaatgatgcctttccgttctttcggattcccggcaacggccagcggcttccctttaagcgcagggttttccgccatttcaaccgaagcgaaaaaactgttcatatcgacatgcaaaatgacacggccttttttcggataaaatgctttcatcttcacccactccggcgctcacgaatttccggccgcttctttcatataagcggcaatgtctgcaatcccttcaagcgacgccgtaaacaaatcgacatccataatggtaatcagcctgtccttcaaactggcgacagccgtaaaataatttgtccgcccgtagccggcaaggccgatctgttttttctcttcttcctgtatttccacaatgtcgtttgcctctttgacgagcaggccgaccggaatggcttctgtccggacgacgatcatgcgggcgtcctctatggaggaaagcggtgtctggtaaaaacaatgttcgacgtcaataatcgggatcagttcatccctcaccttcatgatgccccgtacaaatgcaggcagttttgggacgggattggctgcttgcgccttttcaacagaaatgaccgatccaatatgaatgccgtactcctcttccctcgttttaaaaatgatatatttattgagcgcttccaactgatcgcttcctttcttaaaaaggaagcggttatcccgcttccgcctcaaatcctgttactccccgccggccacttccgcaatggcaaccgccatctcagccagtttgaccagttctttaaccggaattctttcttttgtcgtatggatttcttcataccctgtgccgagattgaccgtcgggatgttaaatcctgcaatgacgttggcgtcgcttccgcccccgctttgctccagcttgctctcgcggccgatttttgctgctgcttttttggccacttccaccacttggtcgccgtctgagaatttaaatcccgggtacacgacgttcacttcgacttccgcttttccgcccatttccagtgccgtctgttcaaaagcggttttcattttggcaacctgtgtttccattttttccggaacgagtgaacgggcttccgccagaatatcgacgcggtcgcaaacgatattggttgcctgaccgccttcaaagcgcccgatattcgcggtcgtttcactgtcaatgcggccgagcggcatttttgcgatcgcttttgcggcaatggtgatcgcggagacccctttttccggcgccacaccggcatgggcggttttgcctaaaatggttgctttgattttggcctgcgtcggggcagccgtcacaatcgtgccaaccgggccgtcgctgtcaagggcaaagccgtattttgcttttaacagcgacggatcgagcgcgcgcgaaccgaccagaccggactcttcgccgacagtaatgacaaactggatatccccgtggcggatctggtcttctttcaatacccggatcatttccaacatcgcggagagcccggctttgtcgtcagatccgaggattgtcgtgccgtctgattggatccagccgtctttgatggacggtttgatgcctttccccggaacgacggtatccatatgggaagtaaaataaatcggcgtcgcttcaggaacattgcctttcaatgtgcagatcagattgccaaagccgtgccccgtttttgcttttgtatcatcctcatatacttcaaggccaaggccttcaaatttttgttttaagaccttgccaatttcttcttcatgtccggtttccgaatccacctgaaccagttcaaaaaattcttttactaaccgttcttcattcaccatggaaaaacctccaatatgtatatgtactttaatagtataacgcgaatgattttacttgtacaaccggcggcttcaggctagaataaaaatgattaccgtccgtttaagaggtgaagtctgctttgtcgaaaaaaacgcagaaaattgtcgtgtacttaatgctcattgccatgctggcaggaacagttctttccggcctttcaatgctgttttaaaaaaggaacgggaaagtccgcgttccttttttaaatggcgccttttgcttttgccagttcggtcatcggccgggttgaccgagtgatgtaaatttttgttccgaccggcacttcatcgtacagcttttcgagcgccgctttcggcaggcggatgcaaccgtttgaaatataccggccaattgaagaaggattgtttgtgccgtgcaggccgtaaatccggccgtccgtgccgcgcgcatcaaaaccgatccagcgcgagccgagcggattgcgcgggtcgccgccgggaatattctttttccggtaataaggatttttcgccttgactttgaccgtaaaaaaaccttccggcgtcaggtcatttgttttcccagtcgcaaccggcgtttcgagccggattttcccgccgcggatccaggcaagccggtttgttgttttattgacaataatgagcgggtctcccggggcaacgtgcccgtccgccggccataccgataacccgaaaacaagcatccatgccacccatatatgcataagccattcacctgctagttgtgtttttctttagtatgcatcccgcataccggttcatgcatacggaaagtgcgctttacacccgggacaccgcccctgttaaaaaaagccttcccctttccagaacggaaggagaaggcttcccgcattacagttcttcacagtattcttcaaacattgcctgcagctcagccacgacagccgctgggtcatgcccttcgatctggtgccgttcaatcattttcacaattttgccgtcttttaaaagtgcgaaagatggggaggacggcggataaccggtgaaatagctgcgtgcccttgccgttgcttctttatcctggccagcaaagacggttacaagctggtccgggcgcttatcataatggatggcgtgcgccgcagccggccgtgcaatgccccctgcgcagccgcacacagagttgaccaaaacaagtgtcgtcccttttttggaaaacgcttcgtccacttcttccggcgtcctcagttcctggtagccggcttctactgcctcttcacgggacatgcgcacgacatcgttcatataaagattaaaattgacagacatgccactcatcctttcattctgctttaaagctaatcatagcaggttttcacgctgcttttcaaacattctgtttgcagccgccacttttctcttattttacgcatgaaaacgaaaaaaatagccggaaagcgtttatttttccaaaaaaccgggtaaaatgacagtacatctagatccatacccctaaactccctagatgctttggatggcgcctcatgcgctgtcccttttttatgcaaaaaaaccggggcatcccggtttccgttttataaagattggacatggacctgtccgagaagcgattctgcttcttgctttgtgcaaagttccatggaaaatgccgtcgcagaaccgcaggcaaccccaagcgcaaacgattctttgtacgatttcccttttgccatcccgcttataaacccggccacaaccgaatcgccggcgccggcagaattttttaccttccctttcggcgcttgcgcaaaataggatacttccttgttcaaaaagagcgcgcctttttccgccatcgaaacgatcacattttcaacgcccatgtcaagcaggcggctgccgtattgtttcgcttcttcgggcgtttcgactttcacgccgaaaatttcgccgatttcatgatggttcggtttgatcaaaaacgggcccgttttgatgacatggccgagcgattcgccggaaacatctgcaatcacgcggatttgcttttcacggcatttttgaatgaggccggcataaatggatggcgggagggaacttgggatgctgccggaaaacaaaatggcatcctctttgtccaggctgtcgattttggcaagcagccggtccagctcagcttccgaaatagagggccccattccgttgatttccgtttccacaccggattttaattttatattgatccgcgtgtcgcctgaaacttggacaaaatctgttaaaataccttccgctttaagaaaattttcaatgtagctgccggtaaaaccgccgagaaaaccgagtgccgtggaatcaacgcccagccttttcatgacgcgcgagacgttgatgccttttccgcccggaaacttagtgtccatcacggaacggttcaatccgccaagctcaaaatgttccacctgtacgatgtagtcaacagacggattcagtgttaccgtataaatcattttttacacaacctttgctttggagatcagttttagtattcccctttttgatggcaatcgttccccgcctgcacgattgcaagcggtgcatccggtcgttattttaccttcaaaaacagtaaaaatcaattaaaatcgttcaaaaacaatcagttttgataaatcgccacattttccaacatagaaaaacccgcttcatcagcgggcatttcattaatagagcggtgccgtttccggtgtgaccgcctctaaaatctctttgacgcgctttaagaagcggccggagacgagtccgtccaaaatgcggtggtcaatcgacaggcaaaggttcacgatatcgcgcgccgcaaacattccctcttccatgatgacagggcgtttgacaatcgactcgacctggaggatggcagcctgcggatagttgataatccccatcgactgcaccgaaccgaatgacccggtattattgacggtaaaggtgccgccttccatgtcttccggggcaagtttcccggcgcgggctttttgcgccagcacagcaatttcatgggcaatgcctttgatcgatttttcatcggcatgctttatgaccggcacgtacaacctgtcttcggcggcaacggcgatcgagatgttgacatcatgtttttggataatggcatccccagcccatctggaattgagcgcaggatactctttcagcgcccgggcaacggctttgacaaaaaaggcaaagtatgtcaggttaaagccttcgcgccgcttaaactcttcttttacggcatcccggtagcggacaaggttcgtaacgtccgcttcgaccatcatccacgcatgcggaatttcctgtttgctgcgtgccatattgttcgcgatcgctttacgcacgccggtaaccggaatcaccatatcttcttctgcagcttcccgtacaggctgaggccgggaagcaggcggcgtatgccgggcaggttccggttttgaaggtgcgggttttgccggttccggttttgaaggtgccggttctgcctcattccccctgctttcaatgattttcaacaggtctttgcgcgtaatccggccttcccttcccgttcctttgacccggttcaagtcaatgccgtattcctgggacagttttaaaacggccggggaatagcggacttttttccctttttccgcttccggctccggcaccgcagcatccggatccaggcccggttccgcttcaggccgggcaattgtttcacttgatccggttttgaccgtgcaaatgacttccccgacagcaacggtttcgtcttccgaagcgatcagttccacgatttccccttcaaacgaagaaggcacttcggcattgactttgtctgttaatacttcacaaagcggatcgtatttatggacatgatcacccggggatacaagccacttgctgatggttccttccgtcacactttccccgagctgcggcatcgtaatgttttctatcgccaattggcaccctcctatcctgcaattctaaaattcggccagttcccgcattgctttttcgactttttcgggattgaccataaaatatttttccatcgtcggcgcatacggcattgccggaacatccggcccggccaggcgcatgatcggggcgtccaggtcaaacaggcagttttccgcaatgatcgcggcaacttcgccgataatgcttccttctttattgtcttccgtgaccagcagcactttcccggttttggcagctgcctcgatgattgcctctttgtcgagcggataaacggtgcgcaaatcgagaatatgtgcttcgatcccgtcctctctaagcttttccgcagcctggagggcaaaatggacgcaaagcccgtacgtgatcaccgtaatatccgttccttccctttttacttcggccttgccgatcgggagcacataatcgtcatctggcacttcgcctttaatcaggcggtacgcgcgcttatgttcgaaaaagagaaccggatcatcgtcccggattgcggctttcagcaacccttttacatcataaggcgtggacggcatgacaattttcagccccggctggtttgcaaacaccgattcaagcgactgggagtgatacagtgccccgtggacaccacctccgtacggtgcacgcacgacaagcgggcattgccagtcattattggtacggtagcggattttcgccgcttccgaaataatctgattgacagccggcaaaataaaatcggcaaactggatctcggcaaccggccgcatcccgtacatcgcagcccctacgccgaccccggcaatcgccgattcagcgagcggcgtatcgatgactctttcagcgccgaactgctcgtataatccggccgtcgccttaaataccccgcctttttttccaacatcttcgccgagcacaaatactttttcgtcccgttccatttcttcccgcaatgcttttgtaattgcgtcaatatatgaaatgacagccatcgttctcctccttactccccgtaaacaaaccggagcgtatcttccggtttggcatacggcgctttttcggcgtaatcggttgcctcattgacggtttgcatgacgcgcgcatcgatttctttttctttttccccgtcaagaaggcccgcctcttttaagtaccggctaaataaaacaaccggatctttttcttttgccgtcttcacttcttcctgcgcacggtagcggtcatcatcatcggaagagtgcggtgtaaagcggtaaacaagcgtttcgattaaagtcggcccttccccgcgccgggcacggtccgccgcttctttaaccacttcataaacagcgagcggatcgtttccgtcaaccgtcacacccggcatgccataaccgatcgcacggtcggaaacgcgcgggttcccgagctgcttttcaatcgggacactgatggcatacaggttattttcacacatgaaaatgaccggcagcttgtggaccgcggcaaaattcgccccttcatggaaatcgccctggttggatgatccttccccgaaagtgacaaacgtaacaaaatcctttttctccattttgcctgcgagcgcaattccggccgcatgcggtacctgtgtcgttacaggggaggactgggtgacgattctgtttttcttctgcccgtaatggcccggcatttgccggccgcccgaattcgggtcttccgctttggcaaacccggaaagcataatgtcgcgcgcggtcatgccgaaagcgagcacaaccccgagatcgcggtaatacggcaatacataatcttttgtcctgtcaagtgcaaaagcagcgccgacctgggctgcttcctgtccctggcaggatacgacaaacggaattttgccggaccggtttaaaagccacatccgttcatccaccttgcgcgcaagcagcatcgtttcgtacatttccaatacttcctggtcgcttaaacctaaacttttatgccgattttcattcattgtcttcactccttatccaaaagctacgcatggatttcaagcccgtctactgcgagtgccgcctccccgatcgcttcgcttagcgtcgggtgcggatggatactcattgccacctcccacggcgccgcatccaaaacgcgtgcaagcccggcttctgaaatcatgtctgttgcatgcggcccgatgatatgtacgcctaacagatcgtcggtttttgcgtctgccacgattttgacaaagccgtctgtttccccgtagacaagcgctttgccgactgcctggaacgaaaaccggccgatttttacatcatatccttcttcttttgctttctcttccgtcaggccaacgctggcaatttcaggattggaatacacacatttcggcaccatggtgtcatcgagcggatccacgcttttttcggcgatgcggtccgccgcaatgatgccttcccttgctgctgcatgggcaagctgcaacccgccgatgcagtccccgatcgcataaatatgggattcttttgtctggtaaacttcattgaccttaatgacgccgcttttgatttcaatatccgtattttcaaggccgatattttccgtgttggccagccggccgaccgataataaaagcttatctgcttcaaacgtctttccgtcttccgtaccgacccgcacctttccgccccctgtctggagggaggatgcgttgaacgcggtaccggtgaaaacggcaaccccttttttcttcaaaaggcgcgtaatttcttttgaaatgtcgctgtcctctcccggcaaaaggcgcggggaagcttcaatgaccgtcacctttacgccaaaatcggcaagcatcgatgcccattccacaccgatcgccccgccgcctgcaatcaggatcgacgcggggagttcttccatttcaagcgcttcgtcagacgtcatcacatattccccgtcgacggcaaacccgggaagaacccgcgggcgcgagccggtcgcaatgattaaatttttcgggaggagcatctcattatccgcacccgcgccctctattgaaaccgttcctgctaccggcgaaaaaatggaggggccaaggattctcccggtgccttcatacacatcaattttcccttttttcatcaaggattggacgccgcggtgcaattgcgccacaactgcgtttttccgttcccggatttttgcaaaattcaaggcggcatcgcggacatccacgccgaaatcggcgctttttcggaccagccggtatacttccgcgcttcttaacagggtttttgtcggaatgcagcctttatggaggcaggtgccaccaagttttgatttttctacaattgctgttttcagcccgttttttgctgcgcggatggcggccacatagccgcctgttccgccgcccaaaacaacgacatcgtattcttttgccaatgttgttcctccttcacttgcattaccgcggaagccttttttcgagcacgtgtttattgtgcggcaaaaactgtgaacgtgcgcgggaaacttttgcaatccgttcttccgccatccggtctgccgccaaataggacgggatcccgtcgcgttttgaaatgtcgatgactttctgtacattatagtagacttgctcgacttttttcatcgctctttcccggttgtaaccgtacagttcgtcagctacattgatcaccccgccggcattgatgacataatcgggcgcataaagaatacccatttcatgcagccggtcgccgtgcttcggttctttcaactgattatttgcagaccccgcaatcacttttgctttcagctgcggaagcgtttcatcattcaaaatggccccgagcgcgcatggggcaaaaatatcacagtcctgggcgtaaatgtcagccgggtccactgcttttgccccgaaagcctcaacagcccgttttaccgcctccgttgaaatatcggtcacaataaggcgggcgccttcttcgtgcaaatagcggcacagttcaaatgcaacatggccgacaccctggacggctacggttttcccctcaagcgaatcacttccgaatgcttcttttgccgcggctttcatgccgacatagcagccgtacgccgtgacaggcgaaggattcccggatgaaccgtacgtttgtgaaacgcctgtcacaaaatcggtttcctcatggatgacatccatatcttcaacagtggtgccgacatcttcagctgtaatatagcgtcccccgagcccctggatgaaccggccgaacgcccggaacatttcttcatttttgtctttgcgcggatcaccgatgatgacggctttccctccgccaagattgagcccggcggcagcgtttttatacgtcatcccccgtgcaagccgcaatgcatcttcaatggcggcttcttccgttgcgtaagtccacattctcgtgcccccgagcgccggcccgagcgttgtatcgtgtatggcgatcaccgcttttaatccggatgcgtcatcatggcaaaacagcagttgttcataatcgtattttcgcatataatcaaaaatttccaatggatttcctccttttccgcaagcaaagctgtcagaaggctgaaccggcatttttgcggctgtaaaacggacatcccgatgcctctttttaaaacggcacaccgctttttccgggatcacgggccagccttcactgttgaaaatgcaaaaagaatgccactttcgcattgttttcctgtttccgcttttcatgcagaaatggcgaaaagagcggggcttaaaaaaataaacttccgtttaccagtttgctactttttgcacgaatatgcaaattattgcatgctgatttttgcaagccggtatttttccaatttatagtacaggcttctcagtgaaatgccaagctgctttgccgtattcgttttgtttccggcattttcttcgagcgctttttggatcagctgcttttcaaaagcggacagcatttcatcgaggctgcctttttcgggtatgtcggccgctccttgcttttcctcgcgttttcccggggataaaccaagcccgtcaagatggactgcatcaatcgatttttcatggaagcccataaaaatgatggcgcgcccgagcacattttccaattcacggacgtttcccggccagtcgtagcggtgcaggatggaaagcgctctgcttgtgatgccttctacattccggccgtaatcctgattgattttttggatgaggcgcctggccagtaacggaatctcctgttttctcgacctgagcggcggaatccggatcggcatccggtcgagccggtaatataagtcttcccggaattttccttctgcaacagctttttcaagatcggcatgcgtggcacaaataatccggacatccaccggaaccggctttgtgccgccgactttcacaatctctttttcctgcaggacgcgcaaaagttttgcctgcatatgggcgctcagttcgccgatttcgtccaaaaacaggctgccacggtcggcttcttcaaacaacccctttttgccgccttttttcgcccctgaaaaagcgccttcctcatagccgaacagttcgctctcaagcagcgattcggcaatggccgcacagttgacgcggacaaatttatggtttttccggctggatgcctggtggatggcatgcgcaaacagctctttgccggtgccggattcgccgcgcagcaaaatcgtcacaggcgtctgtgccgccagtttggcctgttccacggcgatgctcatttcatcggaagcatggataatgtcctcaaatgtatattttgccgcagcagcctgcatcatttgccttctcgcacggcgcaattccgttgtcaatgtctcaatttctgagacgtcatggatcacgccgacgcttccctttagcatgccgttgacgatgaccggcgcaacattgacaatcacttctttttttaacgggccaacccgcattttcacgccgcgtaccggttttttcgtctgcagcactttaaaatgcatgctttcgccttcggaaatatccgctgttgccggtttgccgatgacttcctcttcgctcaatccggtaattcttgtataagccggattgatgaggatgccgcgccctttttcatcgacaacggaaatcgcatcatcgcttgaatggataatggcctgcagcatcatcttgatttcttttaaattcgtaatctcctcagcctgtttcacagcttccgtaatatcccggaaaacggaaatggccccggcgacttccccgccatcaaacatcggaatgtgggaggcgagtattttgaccccgttttgcagttcaatttccacgtttgtttcccttttctttgtttcaaggacacgggcaagccggcttttcgggatcacgcttgagatcggcttgccgagcacttcccgggccgaaacgccgttgatcttttccgcggccctgttcataaagatgatcctgccgtttttgtcaatcaccgtcatgccttctgccgtcgactgaagaatgagcgcatgtttttttgtttcgctttccagctttcggattaaggcttctttttcctccagcaatttcgcaatcaaataggcgacactgccgggaataacaatccggcccgtgcacgctgcaacgatttcatgaaaaacttgctcatccccggttacctcaatgataatatcgacatcggggcctgaaaaaacgtgccagttgtttccggtttgaacgcccatgtttttggcaagccggatcccctccgcctgcggattgatatcaacgatgccggccacacggaaccgtgcgctctcggacaatatttttaaaatcgcttttccgcctttccccccgccaacgattaaaacattttgcatcgctgctcccccttttcgtgctgatctccgctattttattttatttgaaagggcttacatttacaatgggctgcattgcctgcgtccaatcccgggtgttataatggtggaaacggtttaaaggggggccggaatgggcaggctggtggcactttttgtattggcggtgccggtcatcgccgccgcttacgggatcaaatggatgcgggatatggttttcgggattccggaccgcccgttttcctcgctgacgctccagtttctggccgggcttttgttctctgccggcggcattgcctttaccgccggatttattctgcaccgagacagaaagcgccaaaaggtacagaaacgtttcagcaaaccatcaaaataaagcatccggctattgcccggatgctttttcccgttctgcttttctttcctgtaccgcgatttccgggaaatccgtgatgattgccgtgcaaccgattttaaacagccttctcatatctttcgctttattcactgtatacggcctgactgcaataccgtggttcatggtggcgcggatgatccagtcggccgttgtcaaaagacgcggatggatcgcttttgcccggatcgatttcgcgtagacccatggcataaacatcacctccgaatacagcggggcaatctccacttcaggtgccagacggtggcattgaatgatggaatagtggttaaaggaagaaaaaatgaccctttcttccaaatggtatgcccggattaacgaaacagctttttcctcgatcagcggataatccacttttgccgtcttcagttcaatattgcagagaagctggttttgggcgagccattcaaaaacttcttcaagtgccgggatgcttagcggcttgccggtttcgaaccggtcaatcacatccagcgactgcagttcagcaaacgttaaatctttcacataccctttgccttttgtcgtgcgattgaccgtttcatcatgaatgacgaccagttcgccgtcttttgacaactgaatatccagttcaatcccgtccgctccggccttttccgcttcaaaaaaagcttccattgtgttctccggacgtgtgcctgccgatccccggtgggcaaaaataaacgtcactcgatacacatcctttgtttatttcgttcatcattatatattccccgaacaagaaaagcgtaaccttttgcgcacgggatccggccggtacaactcactgcaccggcccctttccctttcaggaagctttgtgttcgaggcggagtttatcagcgaccatggcaatgaactcggagtttgtcggctttgctttggtcatggaaaccgtataaccgaataaggtggaaatggattcgatatttcccctgctccatgccacttctatcgcatggcggatggcgcgctcaacacggctggcagtggtattgtatttctttgcaatttcggggtataacacttttgtaatcgagccgagcaattcaatatcattgtacaccattgcaatcgcttcgcgtaaatacatatagcctttaatatgggccggcacgccgatttcatggataatgctcgtaatgcttgcatcgagattgacaggctttgattccggtttggaagctgccatgccgggcgatgatttcagcacggagccttttttgcttgtctgccggatttgcgaaacaagcatgtccatatcaaacggtttcagcacaaaataggatgcgcccagttccaccgcttttttcgtcacatcttcctggccgaaagccgtcagcatgatgacgttcggcatccgggaataagccgattctttcagtttctcgagcacgccgagcccgtccagatgtggcataataatatccaaaagcaaaatatcggggtccgcctcttttaaccgttcaaggcattccgtcccgctgtaggccgttccgcaaatttccatgtcttcctgctgggatatataatcttctaacaatcgaacaagttcacggttgtcgtctacaataaacactctgatttttttcactgccactgtcctcctcaaaaaaatagccatatctctgtacaagaataagtttcgacaatggcggaaaatttcctgcttttttatttattattttttgttgaaaaccgggatgccgtaaatcgcccggacaaaacgtcctcacgcattataatgatagataagtgcattattctttaaaagcggaaggggacctgccccctccgtaaatgcctgcctcatggagcatccattcgatatggacgccgtatccggatgtcgggtcgttgacaaacacatgcgttactgcaccgacaagccgcccgttctggatgatcgggctcccgctcattccctggacaatgccgcccgtttttttcagcaattccgggtcggtaattttgatgaccatcccttttgttgccggaaatttttgcggaatggtgctgacaattttaatcgaataggcttccacttttttcccgtccacaaccgttaaaatttttgccggacctgtctttacctggtctgacagtgcgatcggcatcggttttgcgtatgtgctgtcttttgcgtccggatccagctgtccaaaaatgccgaacgggctgtttttcgttatattgccgatttgaccttcttcggtaaaacgcgccaatttttctcccgggcttccgtttttgcctttttcaatcgacgttacgactgaattgacaatcctgcctttttcgacgacgatcggtttttttgtatccatgtcggatatgacatgtccgagggcgccatattttttcgttttcggatcgataaacgtcatcgtgccgattcccgcagccgaatcccgtatataaagcccgagtttatacgactgcccgtttttatcttttaacggctttatcgttttccggatggtttgtccatcccttttaatgacggcatccagcgggtttcctttttcccctgcctgctggacaatcggtgcaatatcggacatattttcgatttttttcccgttcaattcaaggatcatgtccccaacttcgattccggcctgttcaccgggagaaaacttccctttgtccgtctgcacaaggtgatggccgacgataaggacgccgagcgtattcagctttacgccgatcgactggccgccgggaatcatcttaatatttggatgcacttctacttccgtctttttgaccgggatgcctgccagttcaagaaacatttcttctttgccggctgacttcccttttatagaaaccgtatgttgatgcgcatgaatttccgcgctgtttccgcttgccattacggcggcagcagcggatttagaaaactcgatttgctggccttccagtaagcgaacttgcttcggaaagtgaagatattgttgaaaaggctgcgaaaaaacgcataataaaagtgaaacaaggagaaatccgcctgtcagcttccttattttttcaaagttcaaacattccactctcctcgcttccggttcaccctgttgtttagcctttgtttgttttggctatgattttaatttagccttgaagcgttttaaatataacagcgcctgcgggaaaaatgctgcccaatctggatagaaagggtccggctccaccatttttccaaataggcggaccggacccttattttatcgcttcggccagttcgagaagctctttcgcatgctgtcttgtcagctctgtcatttcgacgcctgaaatcatgcggccgatttctttaattttttcttcctgccccaaaggcttgacttttgtccgcgttctccccttttcggtttctttcatgatcagcagatgcgtgtccgccatggcggcaacctgcggcagatgggtaatgcaaaggacttgcgaatggaccgagatatggtaaattttttccgcaatcgcctgtgctacgcggccgcttacgccggtatccacttcgtcgaaaatgacggaagtgatcccctggtgccgggaaaaaatcgtttttaatgccagcataatccgcgacaattccccgcctgaagcagtttttgcgagcggttttagcggttcgcccgggttggtggaaatgtaaaattcaacctgatcgagcccgtcgcgccggaacggaatgtcatccgcctcataataatcatcagcagtggcaagaaaacggacttcaaactttgttttatccatatacagctgctttaattcggaatggatattttcagtcagctttcccgcccattttttgcgcaaatcgctgagctgcttggcttccaaataaagatcgcgttttaccgtctgcagttctttttgcaaaagctctacatgatggtcgcggtttacgatcgattcaatttcttcttcaattttggacccgtattccagaatttcttcgatcgtgctgccgtattttcgttttaactggttaatctcattcagccgcgcttcaatcacgttaagccgttccgggtcaaattcaagcccgtcaagccgggaacggatcgagcgggacatgtcttcgagcgtataaaaacaactttggacggattccaaaatgtcagagagcccgccatccacttcggccgcggtttcaagatggctcatggcaaggctgagccagtcgaggccgtgctgttccccggcaagcgcttcataccccgtgttcaatgattcaaacagccgttcaaaattgacgagttttcgtttttcttccgctaattcctcgtcttcatgcagcctcagccctgcgttttggatttcctcatgctggaactggatgaggtcaaggcgctgggcaagctgctggtcgttttcattcattctttttaaccgcccgtaaacggcttcgtattttttatataatttttcgtaatcaaggagggccgtttcgatctcgctttgcccgtactggtcaagcagcggcagatggtacgtttcgttcagcagttcctgcgtttcgtgctggctgtggatatcaattaaagtcgacccgatttcgcgcagcaccgaaatcgtcacaagttttccgttgatgcggcagacgcttttccctgttttcgatatatcgcgccgcaaaatcaccatgccttcctcaatctcaatgccgaattcgcgggcgcgctccatacacggatggccgtcttcgaccagaaataaaccctcaatctcagcacggttttccccgtgccggacaaactccgatgaccctctcccgcctgttaaaagctggatcgcatcgataataatcgatttgccggcaccggtctcccctgtcaggacagtcagcccggcttcaaatgagagggttagcgcatcaataatggcaaaatttttaatcgataattcctgcagcaatcaaacatcaccactttctacagcaagtccaaaaaacgttgcgaaaccgtttcggtctcatcgtgatttttgcaaatgatcaaacatgtatcatccccgcacaaggtgccgataatttcttcccaatccagaatatcaatcaaagcgccgattgcatgcgcgttgccgggcaacgttttcaacacgatcaggtgcccggctgtatcaatgctgacgaacgcatccgtcagcgcccgtttcagtttctgcatcgggttaaagcgctggtcggcaggcaggctgtatttgtacctgccgttattgagcggcactttgacaagatgaagttcttttatatcccttgaaatggtggcctgtgtcacattaaagccggcattccgcaaatgctcgacaagctcgtcctgtgtttcgatatcataattggtaatcatttccctgattttgatcaagcgctgtcctttattcatatcctcacctcaaggatgctcttttgtaaatatgcatctacttgtatgttagcgcatttacggtcaaatgtacaagcagcttttatccgtaaacgggcttttttccgggtgcgaaacgcctttattataaaacagcctaccggttatccaataggctgccaaatctttgtctatcccttcctgagcgtggcatgggcttcttccaccacgtcatttacggttacgcgcaaccggttggcgccgccttctgtttcgctggcgggctttacgaggtggattaaaaattcaatatttccttccccgcctgtaatcggcgagaaggagaggttttccaccgaaaagttttcacgcaaggcaagctggatgattttttcgatcacttcgcgatggacatttttatcttttacaatcccctttttgcccacctgctcgcgccccgcttcaaactgcggcttaatcagggcgaccacatcgcttaaaggtgcaaggagcgtttttaataccgggaggatcaaggacagggaaataaaggacacgtcaatcgaggcaaattccggaatgccctttgtgaaatcctgcggggtaacatagcggaaatttgtcctttccataacaacaacccgctcgtcctggcgcagcttccatgcaagctggttataaccgacatcgagggcataagacattttggcaccgtgctggagggcacagtcggtaaatccaccggtcgaagcgccaatatcgagaacaattttgtcttttacattaagtccaaatactttcaacgctttttccagtttcagtccgccccgggaaacgtacggaaggggatccccttttacgatgagcggggcatcagcagcaattttttcacccggtttatcaaggcgggtctcatttgaaaagacaagccccgccatgaccgccctttttgctttttctcttgtttcgattaatccgcgttctacgaggagaacgtccacccgttcttttttcatttaaaatgaagcctttctttgctgtttttgaggcaatatctgccggacttcccggatcagccggtcctttgtcagcccgatttcctgccataattcttttacgctgccgtgctcgacaaagcggtcgggaatgccaatacggcgaatgatccgatcagagaagccacgatcacccgcaaattccaacactgcgctgccaaacccgcctgcaagcacggcctcttccacggttaataccggcattccggtgcggaaaacggcttcgagcattgcttcatcaagcggtttgataaagcgcgcattgaccactttaaccgatatcccttgcttttgcaaaaatttcgctgcttccatggccatcggaatcgtcgtcccaaaggtaaggatgcacacgtcatttccttctttcaagacttcccaggtgccaagcgggatttcttttaattcttcatcaagcgctacgccgaggccattgccgcgcggaaaccgcatcgcgatcggcccgccgtcatattttaaagccgtgtataccatatgctggccttcattttcgtcttttggcatcattaacaccatattgggcaggctgcgtaaaaaagcaatatcaaatacgccctgatgggtttcgccgtccgcgccgacaaggcccgccctgtcgatcccgatgaaaacatttaagttttgccggcaaatgtcgtggacaacctggtcatacgcccgctgcaggaatgtcgaataaatggacaaaaacggtttcatgccctgggtggcaagccctgcagcaaaagtggcggcatgctgctcggcaatcccgacatcatataccctttccggaagctcctgctggaaccgttccagcttcgaaccaactgtcattgccggcgtaatcgcgacaatgcgcgcatcttcctttgcaaggctgaggacggtatcgctaacaagtttgctccaggcaggaggggcatccgccggtttgataaaatcgccggtttcaattttatactgcccggtgccgtgccaggcgcctttcgtatcgttttcggccggttcatatccttttccttttttggtaacgacatgcaaaagaaccgggcctttcgtctttttggcatactgaatattttcgagcaatgcatcaaaatgatggccgtcaacagggcctaaataagtgaaaccgagttcttcaaaaaaaatcccggagacaagcaaatatttcaatgagtctttcagccgttctgcagtggccgcaagctttccgccgacagccggaatttttttcagcaggaattccagttcatcttttgcgcgccggtatttattcgccgttcgcagtttgccgagcacctggtgaagcgcgccgacgttcggggcaatcgacatctcattgtcattcagcacaacgatgatatcccgtttttcatggccgatatggttgagcgcttcaaatgccatgccgccggtcagcgcgccgtctccgatcaccgggacaatatacgatttttctccttttaaatcgcgggcgaccgccatgcccatcgcggcggacaaggaagtggaactgtgcccggtttcccagacatcatgaatgctttcattccgtttcggaaaccctgaaagcccgtggtattggcgcagtgagccgaactctccagcccggccggttaaaattttatgcacatatgactggtgtcccacgtcccaaagaattttatcattcgggctgtcaaagcatttatgcagggcaagcgtcaattccacgacaccaagattcggcccgatatgcccgccggtcttcgacaatgtttcaatcaaaaagcggcggatttccgcgctcagttgtttcaaagcggggatgtccatttgtttcaaaaaggacgggtccttgatcgattcaagatccaatgcggatcactcgctttcctcatcaatatacggcatcacttacatctattataaacaatcaacgcgtttagacaagaaatacctcatttaaacaaacgccgccggttttgctgttccggccgttcggtttgcgccaaatgaacggccgttaatggtcccgcgtttcgatcatccccgtcagttccattaaggcgccggtttcagcgccggtttcagcgaggcactgctttgcaaggcgagtatggcgcctgagttcttgtttggcaccctcaagcgttaaaagagccggatatgtacttttatggcgggattcatcgctgccgacccgcttgccgattttttcctgttccccctcgatatccaatatgtcatcccggatttgaaaagcgaggccgagatgatcggcaaattgcccgaatttttccagctgctctgttgacgcgccgccaatcatcgcgccggcaagcacgctgaaacgaagcagtttgccggttttgtgggcatggatatattgtagttcctcgagggtcagtgttttattttcgccttccatatccgccacctgcccggcgaccatgccttccggacccgcagattttgcaaggagcgcaatcagttttaccttcaaagcgtcatccaaccccggatcttcggcaatcagtccgaaactgtgcgtcaaaaggccgtcgccggcaagaatcgccaccgcttcgccaaatactttatggttggtcggctttcctctccgcaaatcatcatcgtccattgccgggaggtcatcatggatcaaagaataagtgtggagcatctcgactgcacacgcggtctgcatgccccgaccagccggtttaccgagcgcggatacggttgacaacaaaagaagggggcggatccttttccccccggcctggagggaataatgcatcgcgtcttttaatacagcaggcgcacgaagatccgcgatatattgtgccaggtgtttttcaatttctttcacatcatacgcaggcttctgcacggttattcctcctcccggatctcaaaatcctgctcttcgccatcctccgacatgatttttgccagctgttcctctacatttttcagttttccgtggagtaatttggacagctccattccctgtttgtaaatggaaatggcttcttcgaggggcacatccccttcttccagtttccgcacaatgtcttccagttgcaccatcgcttcttcaaaagttaatgaatcggccatcttttttccccctttcaattttatctaccgtgcacaaaaggccgccgtccgtcaaccggacccggatcgtttcacccgttttggcctggcttgtttttttcaggatcgttccgtcttccgccatagccagactgtagcccctttccattactttcaacgggctcagcgcttcaagggcggaaatatttttggcaaaacgatgctgcttctcccgcaagaccgcttgcatttgcttcacgaggtttgcttcaaggctcgtgaaattccgccgcgcctgcagcagtttctgttcaggacggttgcgcaaaagccggccgtgcagattgcgggtttgttcctccgctgtaccgattaagcgccccgcttccctgtgcaggcgatctgtaaggcgatcagcctgctcgatttgctggcggatgagccggtaaggatttgtcaaaacgggcgaccgttcaaggtaagcaagccggcttttttcatagcgtactttctcccgcatgtttcgtataagccgcgtctttaaatgcaagattttttcccgtacgtcatcaatatggggaacagcaagttcagctgcagcagtcggcgtcggtgcccgtaagtctgccgcaaaatcggcgatcgtaaaatccgtctcatggccgacagcagaaatcaccggaatatttgacgcaaagatcgcccgggccgttatttcttcattaaaagcccacagctcttcgatggaaccgccgccccttccgacgatcagcacatccgctttgccgatccggtttgcctgttcaattgcctttacaatcgaaggggctgcattttccccttggacaagggccggatgtaaaatgatttcagcaaccggatatcttctcctgatggtggtgatgatatcgcggacagcagcccctgtcggcgatgtgatcaccccgatcactttcggataagccgggatgggccggcggttttgaaacaggccctctttctccagtttttcttttagctgttcaaaagcaagataaagtgcgccgattccgtcaggctgcatgcttttcacatacagctggtaactgccgcctgcttcataaacagatacggaacccgtaacgagcactttcataccgttttccggcataaacttcaacgtccggtttgcagaagcaaacatgaccgaaagcagtctcgctttttcatcttttaatgtaaagtacatatggccgcttgaatgccgtttgaaattggaaatttccccttttacatggatatcgtttaaataagggtccgcgtcaaatttccgtttgatatattttgtcagcgtgtgtacggataaatattgcatcgctttccaccacctttctcatgcatgaagaaagctgccttcccgccggaagtcagctttcttttaatgccgcccgctcccagcacaaatgtctcccggcacacttccggacgaaaagcggttttccagaaaaaatgccatagcggcagggcagcctgtttaacggcgcaagcgttttgcggcttttactgtattggaaagcagcatggtaatcgtcattggccctacgccgcccgggacaggggtaatataggaagctttctcctttacttcatcaaagtcaacatccccgcacagcttcccggacgcgtcacggttcatcccgacatcaatgacggcagcacccgctttgacaaaatccgctttgatgaattttgctttgccgacagcactgaccaaaatatccgcctggcgggtgaaagattttaaatcggccgttttcgaatggcagtatgtgacggtcgcattttcattgaggaacagctggccgcatggtttgccgacaatattgctgcggccgattacgacaacatgcttcccttcgatccggatgccctttgacttcaccatttttaaaattccgtggggggtgcagggtaaaaaggtatcctggcccgtcatcatcctcccgatatttatcggatggaaaccgtccacatctttctccgggctgatcgcttccacgattttttgcgcattgatatgcggcggcaaaggaagctggacgagaatcccgtgaatgtcaggatcttcatttaaggttgcgatatgtccgagcagtgcctgttccgacacgtcttcgggaagctcgattaaaacggatttcattccgagcgcgcggcacgctttttctttgtttttgacgtatgtacgtgaagccggatcgtttccgactaatatgacagcaagccccgggataatcccctgttgcgttaactgctccgcttccgcctttatctcttttctgagtgcttcggccagttgttttccgtcaatgatttccgctcccattatccatcccccgttatttagattcaatcgagtctttcatttgattcaaaacgccattaataaatttggcagatttttcatctgcaaaccgtttggcaatctcgagtgcttcgttgatcgccacattggcgggcacatcctctgcgtacatcagttcgtaagcggcaaggcgcaaaatattgagttccacttttgcaagcctgtcaagcgtccaattttcaagatgctggctgatcatggcgtcgatttccgcgagatgtgttgccgttccgtttaccaatttctcaagataatcatcactttcctgcccgtccagcgcattccggatcgcatcttccgggctcgcttcattcatatccatctggaataaagcctgaagcgctttttcgcgggcggttcttcttttcatcattcggcagtaactcctttaaaaagctcaaattcgcatgcttttattgtaacagaaaggtgggaccaaaaaaaggccaggacgctttgcccggaccctttttctcttactcttccgcctgaaattcaggctccgctttctgcgtatcaaattgaatgccgacaatatgaatattcacttccgacgcttccagggcagtcatattgagcaaagcctggcggatattatcctggacttcctgggcaactgccggaatggaaacgccaaaattcatggtgcaatagacatcgactttaatgccatcatcactcagttccacttttacgcctttcccgtggtttttcctgccaaggcgctccacgacgccgcttgcgaaattgccacgcatttgggcaaccccttcgacttcggaagcggcaatgcccgcaatcacttcaatcacttcaggagcaatttccacttttcccaagccgtcttcatcatgatgcatttccaacatttggttgtcttctgccatcttcaacacctcctataattacacgttatttcattacatcatatttttcaaggaatttcgtgttgaaatccccttcgacaaaaacttcatgttcgaggaggcgctgatggaacggaatcgtcgtgtggacgccttccacggcatattcgctgagcgcgcgtctcatgcgagcaatcgcctcatcgcgcgtcgctccgtaggcaatgagcttggcaatcatggaatcataatacggcggaatgctgtaacccggatatacggccgattccacgcggatgccgatcccgcccggcggcaggtaaaagttaattttgcccgcagacggcataaaattcttttccggattttcggcattgatccggcattcaattgcccagccgttccatgtgacttcatcctgctttaaggataacggttccccggatgccacaaggatctgttctttgacaagatccacgccagtgaccatttctgtaaccgggtgttccacctggatgcgggtattcatttccataaagtaaaacttctggttgcggtggtcaaaaataaactcgatggtgccggcccccgtatagtcaaccgcttttgccgctttcacggcagcctgccccatttcttcgcgcatttcgctcgatagtgccggggacggggattcttcaagcagtttttgcagccgccgctggatggtgcaatcccgttcgcccaggtggatcacattgccgaatttatcagccatgacctggatttcaacatggcggaagtcttcaatgtatttttcaagataaacacccgggttgccgaaagcagtcgcggcttcctgctgggtgatgtggatgccttttacaagctcttcttcattcaaagctacgcggatccctttgccaccgccgccggccgttgccttaataatcaccggatagccgattttttttgcgacgacttttgcttcttctgcgtcttttacaagcccgtccgaacccgggacaatcggcacgcccgcttttttcatcgtttcgcgcgccacatcttttgcgcccattttcgcaatggcttccgggcttggcccgataaactcaatattgcattctcggcaaagctcggcaaaatcggcattttcagcaagaaatccgtaaccgggatggatcgcgtcacagcctgttaaagttgctgcgctgatgatgttggcaaaatttaaataactgtctttcgatgctttcgggccgatgcagtacgcttcatccgcaagctggacatgcagtgcatctttgtccgcttccgaataaacggccacggcttcaatcccgaggtcgcggcaggcacggataatccgaaccgcaatttcgccgcggtttgcaatcaaaacttttttaatcatgaaagtccgctccttactttgtctttaccaaaaataatggctggccgaattcaacaagctggccgtctttgacgaggatatctacaatttccccttccacttccgcttcgatttcgttaaacagcttcatcgcttcaatcatgcatacaaccgtattcgggctgactttggagccgatttgcacatacggttcttcttccggggaacccgcctggtaaaaggtgccaaccatcggcgacacgattttatgcagattttcgtcggctgcttgcgccggagcttcaggctgcgggttttctgcaagctggcggggctgcgcaggcatttgcgggggtgcggaaacctgagccacttcacgcaccgggcgttcaatgacttggacgccggtgtttttcttcattttgatgacggtcccgtcgttttcaaattcaaattcatcgaggtttgaacggtccacaagctcgatcaaagcctggatttcctctactttcagcatatatgacactccttcgttttttcagcttctaaaattgttaacaatttatgaataaataactatccatatcatacgataaccggaggcgaaaattcaatcatttgtataaaaaacggattcccggcacattgcaaaaatgcccttccccgcttggcgcaaaaaggaggaagcgttttacggaaatttaaaatcacgcgcaaatctatttttcaatcatttttcaatcattttttaaatatagaaaaaaagcccggcaaaaaagcaatctcccttgttttccgcacagaaaaaagggctgtaaccgccccctattctggctttccttaatttgtctggaattccacggccagttttggcgtattgcccaattcctggttcacaagcttgacgatttcatttgcagccgctttatcgtgctttttcgatttgacggtcacgaccacttcatcgccgtctgcctgaacgagcgcatcctcatatccttttgctttgatcaggctttctaaaacctgttctttattcgccgtctccgttaattttttcatttcatccattgccttgcttttttcatccggcgtcaggtcggtcgatgcgagtttattggtcagttcttcctgctttttgctcatttcatcctgccgctcaaggcggagcgtctcaaacacttcatcactggcagactttgttgtcaatttgattttttgcgaaccggaagccttttccttcgttgccgcagattccttttctttttcttgccgggtaacctgattcgtcgtttttggttccgccgtcacatagtacacggacaaaaccacaacaaggcttaacatggtcaacagccagaccgtttgttttttcaaaagcatacccattcctcctcattctttttttggcatgacggaaacacggtaacttgcgatatcaagggcgcttgcaacagcttcttttaccgatttttggatggagacgtcgccgccaccctcgcaaacgactaacacccctgtgatctccggcttcctggtttccgttacaagcggcacttccttgtccccgttttggacgatgacgactttatcatcttttgaaatgctgtcaattttccgttccccgccgtttttatctgtttcggttgtcgtttcattccggatggtggcgtttttttcgtacactttgctttctgatgtggccacattcacttggacgtttacggaaccgacgcccttgatttgttccagaatgcttttcagttctttctcatattggttttcgtacgtggagatcgattttgattttttggaagtgcctgcaccgaatgcggctgtcccttttccgcctgccgtttttacgggtgaagatgcagtcagcgcttcgtttttttcgcttgaagtcccgaaaaggtcgttgataaacatcatcccgagaccggagatcaatagtacggttaacaacacaagctttttctttttatccggcgggccggatggcagccatttttctttcagttttttgaacggtccctggttacgatccattttcgttttcaagccccccttcgaaacggagatcaattttttctttattgattttccagcgatttgacaacatggcaatgatcgattgctgctcccgtgtgctttgtttttctgtttgtttatccgtcccgatttcaaccggtttaatggcagcaacagtctctttttcgttttgcgcttccagatagacgtggattttttttacgtttgacgcttttaaagcggtaagatccccgcttttggccccgtctttccactcgaccgtgatttttgaaatcgattttccaaacgcttcctctacctccccttccacatcctgcttcagttggacagccatttgttgtaatgtatattcctgctgcatgtcatttatttcttttttcttcgtttcaagcgcattttcttccgcagacgggcttgaagtactggaatccccgaatttttctatccatatggcaggatctgtggaaaagagccggaatacgggtgtgacgatgatggcaatgagcaaaagcccggtcacaagctttgtatatttccgcatcccggagtcaggcagaagcatgtccgttatggtcgccaaaaggataaaaatgatgatattcagcacccattttgtcaaaacgtccacaggtctccccccttaacgcatcatcatcgtaagattgcccgccgtaacgatgatcgtaatgctgagaaaaaacatgatggtcacaatcgcgagggcggcaaatacgtacagcatgtttttgctgatgatatcaagacagctgatgaccggccccccgccgagcggctgcaaaagggcggaagcgagcttgaacatgaacgacatggcgaaaattttgatagccggaaacgccgcaatgagcagcacaatggcgacacctgcaatgccgagcgtatttttcaaaaggacggaagcgctgatcaccgtatcggcggcatccgtcagcatccgcccgacaaccgggacaaaattgccggtcacaaattttgcggtcctgaccgcaagcccatccatcaccgccgttgccgtcccctgaacggacaagacgcctaaaaacacagccataaaagcgccgagtatgccgatcccgagattgcgcaacagaccggccatctgtgttgctttgtgctgttccgagagggtgctgacgacacctaagagcgttgaaagcagcagaagcggcagcacgatgatctcgaccagcatgccgcttgtgccggagagaaaaataatgaccgggtgaaaaaaggctgccgatccggcaccgcccgatgtggaaagcagcgccagcaagagcggcatcagcgccaggataaaacctttcattgtccggatcgcctcaagcgcatattgaagggcgacatgaaaactgttcagggcaataatgacgagcaccatgaaaacaaccgcatacgcaattttgctgatcgtcccttgctggaacgaatgatgcaggttttccagcaggatgctcagaatcgtaagaatgatgagggagcctaatagttttgcattgatcagcagctcctgaaaaatatacgaaagcagccctttcagccaggcttgcaaagaaaaatgcttttcgcctttcataaaatccataaggctccctttctggctttccggcaagtatccgccgtatttgctgacaatttcatcccagtagtttttcagttctgataagtccaattgattcagttgttcatcgaccattttttccggaatgttctcctgtttatccgtattttccgaagcggcggatgccggctgtgcgaagaaacagaaggcaaacagaatgaaaagcgcgatgcacatttttttacgccccatattctcaactccctgcacgcggaacgagattgacaatcgtttcaatcagcacggtaagaatggggatggccattgttaaaattatgattttgccggccagctccacctttgccgcaagtgccccctgcccggcatcttttgtaatattggatgcaaaatcggcgatataagcgacgccgataattttcaggatcgtttcgatatacatcgtgtcgacattccctttttgggcaattttttgcagcaggcggatgatctcatatatcttgtccaccagaaatagaaagataaaacagccggcaaaaagcgtcagcaaaaaggcaaaattcggtttctgctcttttaatatgagcgcaaggaaagtcgtgatgagcgccacacccgcaatttgcaaaatttcaatgggaaatccccccttttttcccggcttactgaaaaagaaagaccgttttgattttggaaaacaaatcccctacgatggatgccactaaaaacaaaatgtaaagaaaaccgagaagcgtaacccattgcgcatattcttttttgccaacctggtcaagaatcgtgtggagaaatgcgacgacaatcccgaccccggcaattttaaaaatgatatccacatcaatgcccattgcttttcccccaatatgatccgtgcatctctcagatcagtaaaatagcgatcagtaaacccgtgaggacgccaaggctttttgccattttttcatagcggagctgcctttcgtgcgcttctttttcttcccgttccaaatgtgaaagggccaggagcagctgcttttgctcggtatagcggtcatgtttgcccaggttttccccgagttgccgcaatacttcatactcattttctttcagggccgtcatttcccaaatcccgtcaaggcttttttcccatgcttcttttaccgttgtttccaatgttgtcaactggccggcaaaggaacggaagaaggcggcagccggatccggaagctggtctgacagttttcttgccgcttcatgcagcggggtatgcccgtacatgatttccacctccagtgcttgaagcgcgctttgaaaaattcttagctggcgggggcgttcgcttaaccgtttcgctgcctcaaagccgatgaaactggtggcgaacacaatcagtgctgctccaaaaagtttaagcacgggaaacaccttcaccggtacgaatgatgttcccttccgcatcccggactgctgttacccttcccggccggctcccccgcgacagttcgagaaaacggtcaaacgcatacaattcgaggattttctttaaaatcgggcgcttatttatatcccggaagttttccccgtgcgttgtcatgacgagcgaaatgcccgcatttaccgcctccataattgccgccgcatcttcttcgcggccgatctcatccacgatgatgacatccgggctcatcgaccggatcagcatcatcatcccttccgctttcgggcaggcatccagcacatcgacccttggcccgaaatggagttgcgggatgccgtggacgcagccggcaatttcagaccgttcgtcgacaattcccactttggcgggcgaaatgccgcgttccgggatcccggttgaaatcagccgtgcgatatcccttaaaaatgtcgttttcccggtctgtggcgccccgatgatcatcgcggacaaccagtgcccgttgtgaagggcagaaagataaggatctgcagttccgattttttcccgggcaatccggatattaaaagatgaaaaatagcggatcgcctttacttgtccattttcaagaatgactttccccgcgaatccgacacggtgcccgccgctgatcgtgacatatccctttttcagctcttcttcaagggcgtaaaaggagaaattcgcaagccggctgatcagctgctcggcatcgctctccgttggcatgtagcgcaaaaaatgcgggattccttttgaagtaatttcaagcgggcggtttacgcggatgcggatttcttccacatcttcgagtatatcccccaacttttccagctggttggataaggatttcggcaaaatgcccagcaaatcttccattcttcatccctgctttcaaaacatacagtttggttcatggatagtacaatctattcgccaggtttgaaaactatgacaaggaagcagtggcaggctccgaaagtttaagttgtttataatatgattatgtaaacttattttttcctatcttgccggaaaagcaaaaaagcttgacgccgtttgggacgccaagcttatttcaaagcaatcaggcacgggacacgtatgaaccgtccgttgtattgatgatcaatttatcgccttcatttacaaagaaaggcacctgtaccgtcaggccggtttcaagcgtggccggtttggacccgcctgttgccgtatcgccctttacccccggttccgtatgggtaactgtcagcgtgaccgtattcgggagttcaatgccgagcgtttctccttggtacatgatcatttgcacttccatgttttccagcaagtattgcagctcgtctttaatttgggcgctgctcagctcgatttgttcatacgtttccgtatccataaatacgtgctggtcgccgtttgcatataaatactgcattctccggttgtcgatctgtgccctttcgactttttcgccggcacggaacgttttttcctggatggcgccggtacgcaaattgcgaagcttcgagcgcacaaaagcggcgccctttcccggtttaacatgctggaaatcgaggacgcgccagatgccgccatccacttcaatcgttaagccggtgcgaaaatcgtttactgaaatcatatttttcctcctacatgttcattcgatcccctgttaagggctgtaactattataatataatcagttcttttgcggaatgcgtcagcaattcattcgaattttcggtcatcaccgtatcgtcttcaatccggacgccgccgacacccggcacataaatacccggttcgatggtgacaaccatgcccggttccaaagtataagccgagcgcatggaaagattcgggccttcgtggatttcaaggccgatcccgtgcccgagggagtggccgaacgcttcaccataacctttctgagcaatataatcgcgggaaatggcgtctgcttcaacaccggacatgcccggtttaatgttttcgacggcaagcagctgcgattccagcacaatattgtaaatttccttcaattgctcggaaggctccccgacggcaaccgtccttgttatatccgaacaatagcctttatagagcgcaccgtaatccatcgtgaccaaatcgcctttttcgatcactttgtccgtcgccaccccgtgcggcatggcagagcggaggccggatgcgacgatggtatcaaatgaagaagcggtcgcgccgcatttcctcatgaaaaattcgagttcattggaaacttccaattccgtgacgcccggttttaagaagtcaaggatatgtttaaaagcagcatctgcaatatccgcagcttcttttaatatcttaatttccgcatctgttttgatcaagcgcaaattttcaacaagtccggaaaccgggaccagttctgcatcgagtagcccttcatacgttttaaaaagcgcatagctcatatggtcctgctcaaacccaagccgtttgattcccattgcttctacctgtttggccacttcctgttccaccggtccctgatgctggacgatctcgtagccttcgcactcttttgatgcctgctcgacataacggaaatccgtaataaattttgccccttccccggatataaggacaatcccggtcgttcccgtaaaattggacatatagcggcggttatacggacttgtaatgagcaagccgtcaatagcggcctgcggaaatgtttctcttaatttctccagttttaacatctttcttcctctcccttttctgcctcaagcaaagccatgagggcaagctcatagccgtacagcccaaggcccgcaatttgcccgcgcgcaacagccgccgttacagaatggtggcggaattcctcgcgagcatggatattcgaaatatgtacttcaatcaccggtagacggatggcactgatcgcgtcccgcaaagcatagctgtaatgcgtgaacgcgcctggattgaaaataatcccggcaaagccttcatccccggcagcatggagcttgtcaatcagggcgccttcatggttggattggaaaaaaccgatggcaacgccgtactttcgggccgccgcttccatgtgcgccatcaaggtttttagcgaatctttcccgtaaatgccgggttccctttgcccgagcaaattcagatttgggccgtttaatacgaggtattttttcatttcaagcacctttttcccatatttaacgtgcccattttaccacaaattgaagaaaatttctattttttaactttccggtcgcatgcatctccctgaatccgggtctcgcgcttcttcccgcccggatcgatttacgggagcgggttcgactgcctctccagttttctcttaaaaacccggcttctttcatactcaaacgaaatcgagtaaccgataaacacaccgtagagaatgtaaatgcaacagcaagtgataatcgtattggcatcgagttttaaaaaaggcttcatgccgggaaaaatcggattcagcacaatcaggacgaccgcgcacaggcaaagcccgtagatcgcgcccacccacatcgatttcaattttttaaagaaaagataatagacaagggcacagccggtagaaaacaatccgtataccaatatggaaatggtttttccgatccacattttgcgccaggatccgaccgtaaatggttcaagcaggacattcggttcaatcgccgtaaaatgaaaagaaaagcataaataggcaaccaggctccaaatgatcccgcccgcaaatccggtcataagcaccatttgaaaaaaggtcatggaatgctcctggtttttcaatgctttactgttattttccatattttccaccccttcacatgtgacggcgcgcatcttttctttcttatctttcccataagtctttcccctagtcgtatttaaaatgatttagtaaaataagcgtaagtaacgtttcggaaatccattccgttttaaacgggaaagaaacattcgaagtttaggtttgggggagaagaaattgacaaaaccagcttatggcggccaggcagtcgtggaaggggtcatgttcggcggaaagcggcattcggtcactgccatccgccgcaaaaacaaccggatcgacttcttttatctgccgaaaaagacgcgcccgtccattcaaaaattaaaaaaaatcccgtttttgcgcgggatcattgccatcattgaatcatccgcaaacggggcaaagcatttgaattttgcaagcgagcggtatgatgttgacccggaagaagacgaaaaacggaaggaagcagccccggcaaaaacaacggtggtgctcggcgtggctgctgccggcgtcttgtcctttttgtttgccaaatttttcatgacgctgattcccgtttttctggcagaactgacaaggccgtttttttcaggagataccgcgcaaattctcattgaaggcgcgtttaagctgctgctcgtgctttcgtatatttatttgatttctttaacgccgtttatcaagcgggtattccaataccacggggctgaacataaagtcatcaatacatttgaaaacgggcttgccctgaccgttgaaaacgtccgctcgcaatcgaggctgcattaccggtgcggcagcagttttattctgtttaccgtgattgtgagcgtcctgatttatacgcttgtcccgacagatccgctctggcttcgcatcatcgaccggattttgctgattccggtcgtgctcggcacgtcgtttgaagttcttcagctgaccaataaagtccgccatattccggttctgaaatatcttggctatccgggcctgtggcttcagctgttaacgacaaaagagccggatgacaagcaaattgaagttgcgatttcctcctttcaggcgctgcttgaactggaatcgggtgatatggcttctgccgcccgttaaaaacggcgtttgaagtttccagtgcatgggaatacatttactatcacaagcttgtttgtgcgacggggtaccaacctcaaaataaaaacggccggaaccgtataaactgatagaatgatggaaaaaatggttaggaaaacatgaggaggtggcttttgttgaagacgcgtcaatggatcatcgccggcatttttcttttggccctgcttggcctgggttcctctttgtttcatgagccggttgtattcttaaaaagggttttgatagccttcatttttgcggcagtgcttttggctggcatgcgtttcttactcaagagaagcacaaatgtttccaaccaggaacaaaaagcatttttaaaagccgcccgcaaatccagaaaaagaatgaaaaaacggaatatgaaggtccatactgtccacacggttaaattttcaaaacggccgctgcgcaaaaaatccaatgtccagttaaccgtgattgaaggcaaaaagggcaaaaagaaaaatcgagctgtctactaagctcgattcttttttaattaataggaccacgttttcagaaacgtttctgtttttttccggcccgcctcgattaaggctgctttttgttcggcggaaagctgaaaatctgtggcaggtacgccatctgcagcgataaaaataatgtccttttccagttttcttgaaatatagcgggcatcatgggcgtctttcatcgtcttgaacaaggcatcgaacagctggatcgcattttttatctccgcatttggctcttctgattgttttgggctaagcgtgatgccgagcaccggccgcgcctttttttcttccggtttgacaaacagccacatcggaaaattgcttaaaacgccaccgtctgcaataaggctcgtgccttccagcgagcgcagccgtaccggttcgaaaaaatacgggatgctcgcgctcatccggatggcctttgccaccggaaaggtttgccatggcaccccgtaacgctctaggtcatctggcaatacaacaagccggttatgggtaagatcggatgccgtgaaataaagggagccttttggaacatctttgaacgtgtacacgcctttagatgcgagtttttccccgatccattcctcaaacgcggcgcctctgtacagcccgagccgccaatacagcagcagccatttcgcaaacggcaccggcagcagcgttttccgctcgtcaaggaacgcggccgtgtctgtttccgcaagcatttgcttcatttcgccgcttgtataccctgcagccaacagccctgcaaaaacggaaccgacgcttgtgccggccagccgtttaaacgtaaatccccttttttccaatacttccaatgccccgatgagcgcaaggccttttatgcctccaccggaaaaaaccgcatcaatttccatggaaacccacccttggattcgcatcgggcgtttcggtttgttggtcagaaaagatacggaatgttggcaggatgccctgcttaagcgaaagatgaaaaatgcttttttattattttagcgcacaaggagaggaattagaacaaagcgttcatacgggactataaccgtgccatgctcctggttagcacagcctgcgcttcctttaccatttcttctaataattgggcaacagacgggcagtcctcaataaggccggcaatttggcccccgtttataaaaccgtgctccatatcgccttgaagcgctcccctttcatgatggacttcgcttgtcagcgctttaaagcggcccggatccgcgccgctttcttccagttcgcggagatagaccgcgtacgcatttttgaacactctgcgcaccatttggtatcgtctgccgatgatcatcgtcgcttcatctgttgcttccattacagccttcttatatacagggtgaaactgcgcttcttttgttgcgatgaatctcgtccccatttgcacgccgtatgccccgagcgaaagcgccgccgccaaacctttgccgtccgcaatccctcccgctgcgacaaccggaatgttgaccgcttttacaatctgcggaacgagcaccattgtcgtgctttcattggcagcattgattcctgctgcttcgtatccttcgcatacaaggatatcagcccccgctatttccgcttttttcgcctggcggacagtggaggagacacaaatcacttttatgccgttttgatgcagaaccgggatatatttcgaagggttgccggcagatagggaaacaaccggaatctttttttcaatggctaaccggatgacttcgtccgcgtttggatgaaccgaaatggcaatattgacgcagcagggggaagcggccaggctgcgcattttatccattcttttttcgatttccgctacgggcagcgtcccggcgccaatcgttcccagcccgccggcgttggaaacacttgcagcaagggcaggatcactgatatttcccatcccgccttgaaaaaccggaaatttgatgcccaacatttcagttaccggatttgccacttgatcgctcctttctgcgctcggatctcgtcatgctttttcagttataagcggatggtcaaacacatcataatgtttgcttttctgaaaagtgtcgtatccttcagaaaaaatgtcttcgaaaaaatcatttgccggtttggcaaggattcggtaatagtcccggaaaagcgcggctgcttcctcccccttccatttttccggcagcagttcttccggcaaaccgggatccacaaacaatagtttccggtaattatggacaagcatcgtccgttcgacaaagcagtcctgattcgtcatttcccctcttttcatcttttctttgacgctttcatatttttcccggtaatgggccataaaatcttcataccggtcgttcatataatcaatatcccataattcctgtacaagttctttatcggatttgccccatacattttcggcagtgaagattttgacatattcattgatcccgtacttgtcgatgattcctttcatttcatccagcaaatcattcggcgtaagccagacactgtttaacaggaggccgaagccgctccacatcagttcttttctcagttcatccctgatgttccgctttttttcgggtatcgtatacagaaaaaaccgccatttgccgtcccatttgcccgggttcagtttaaaaatccgcccggcagcctcattcatccgttttacaccgcgttcagtcaaagaatagtaactgttgtttccttctttgcggctttccacccagccttgtttgctcatgcgggaaatggcagcacggacagattgctcatggtggccgaacgcttccagcaatttgattaaactgccaatccaaatttcgcttccgtaatggcggatgtaatcgccataaagcgtaaaaatcatcgaacgcgtatttaacgttttttccatttataaactccttgtctctgccaaagatctctttcccccattttaaattttttcgataacggttgcaatcccctggcccaccccgatgcacatcgtagcgagcccccgttttgcctttcgcttttgcatctcgtggacgagcgttgttaaaattctcgcgccgcttgctcccaatggatgtccgaaagcaatcgcccctccgtttacattgacaatctcactgtccagttccagctgccggatgcatgcaatagactgggaagcaaaggcttcgtttaactcgacaagatcaatatccgaaatagtaaatccggcgcgctttaatgcttttctcgttgcgtacaccgggccgagccccatgatccttggttccaatcctgccgttgcgctggcgacaaaccgggccatcggtttgacccccaattggacagctttttcagcgctcatcaatagcacggcagacgccccgtcattgatgcccgatgaatttccggccgtcaccgtgcctcctgcaaaaagcggtttcagccttgctagtttttccggcgtagtatcggggcggggatgttcatcctgggtgacagacacggattcccccttttgattcgtatacacgacaggcacgatttcatcttggaagcgatttgcttccatggccgctttcgccctcatttgcctcgtaaaagcaaaggcatcctgcgctttccggctgatatgaaattgctttgcgacattttccgccgtttccggcatgctgtctgtcccgtacattttctttaatttttcattgacaaatctccatccgatcgttgtatcaaacatttccaaattgcccctcgggtagccgttttccggctttgccatgacaaacggcgtccttgtcatgctctccgttccgccggcaatataaatatccccgtcaccaaccatgatcgctttgactgcgatattgacagcatcgaggcccgatccgcataagcggttaacggttgtgccggcggtttcgaccggaagcccggcgagcagtgcagccattcttgcgacattccggttttcttcgcccgcgccgttcgcatttccgagaatgacctcttcgatttcgttccagggaacttcgggatggcggccgagcaacgccttgatggcggttgccgccagatcgtccggccttactgattttaacgctcctttatatcgcccaatcggtgttctgaccgcatcaacgatgacgacgtctctcatcttcattctccttcaaccgttgtgtaatcatatacgcccttgcctgttttccgcccaagcctgcccgctttcacgtacttttccagtaaaggcgccggccggtacttttcgccaagcttttcatgcaagtagcgcaaattgtttagccttgcatccaaaccgaccaaatccgccagttcaaacggccccatcggaaaattcaagccgagcttgacggctttatcgatttcttctggtgtccctaccccttcctgcagcatgtagaatgcttcgtttccaactaaacagctgattctgcttgtaacaaagccgggaaattcattcacgatcaccgtttctttccccattttttcagcccgttgaaccgtttcatcgcttgtttcaagccccctgatgatctcgacaagcggcattttatgcaccggattgaaaaaatgcatggcaatgacagatgcgggacgggtagtaaaagaaccgatttcagtcgggctcatcgttgatgtattggtcgcaaggatgcaaccggcaggcgcaaacctgtccattttttcaaacacttctttttttatttccgttttttccggcactgcctcgatgatcacatctgcacaaccggctgcagccggcaaatcaacggtatattcgatatttgcctttatcctttcagcgtctgccccgttgattttccccctcgaaagccctttttccatgacggattcaatcctgttttccgcttgatgcaagatgtcaggccggacatctaccagtctgactttgaaaccgccgagtgcgcccgcataagcgatgccgcaccccattatccctgaaccaatgacaaccaatgtttccgccatcataccacttcctctttacattttctatctttttagacgatttttaaaagaagcgaacccatcccgaaagaatgcgttcgcttcttatttgtccatcttgccctgccggatacccgtttcactgccagtgcagcaatgagtgcctttattcgaccggaagcttataactgaaacgggtttaaaggttttgcccctgcataagtgagtacactcttggtttcactgtataaatcgaggcattcgaagcttaattcgcgcccgaagccggattgtttatatccgccgaacggtgtccccgggaatgcggagaacgggctgttgaccatgacaatgcctgcctggatgccgtctgtgacccgcttaattaggccctggtcctttgcccaaatgcttgaagccaggccgtacttcgtcgcatttgcaagttttacggcttccttctcctctttaaaaggcatcaccaccacgaccggcccaaaaatttcttcctgggcaattttgctgtcattggtgacgtttgtgataatggtcggttcataccagtaaccattttcaaacccttccactttagccggttttccgcctgtcacgatggttgcgccggcctgctttgcttcttcgacatagcggtggatggtttccagctgctctttgctgatgatcgccccgatatgcgaggcaggtgaaaacggatcaccgagcaccagttttttcgttttggccacaaatttttccataaacgcatcgtaaatgtcttcctgcaggaaaatacgggatctcgcttcgcacgattgcccggtattatagaagatgccgtacagggcaccattgacggcggcatcgagatccgcatcctgaaatacgagattcggagattttccgccaagttccagcgtgactcttttcaatgtttccgaggcgtttgccatgatctcttttccggtggaagtttctccggtaaaggcgattttatcgaccccttcatgcttcgccaaataagacccgattttcgcccccggcccggtaatcacgttcacaacgcctgccggaacaccggcctcatggcagatttcagctagtaaaatggctgtaatcggcgtaaggcttgccggctttaccacaacagaacatcctgctgcgatcgccggggcaattttccatgcagccatcatgagcgggtaattccatggaatgatctgggcagcgaccccaaccggttctttttgggtatagttaaagaactggccgggaacatggttcacagcgccgcgatgcccgacaattgcccccgcgaaaaactcgaaatcttcaatggcctgcatcacttgccccttagccgtttcaatcgtctttccggtatttaatatttccatttcaacaagcgcatcaaaacggctgcgcataatggaggcaattttgttcaggacgcgcgcccgttttccaaccggatagcgcctccattttccgtgttcaaaagcatggcgcgccgcctcaacggcccggtcgacatccgcgtaatccgctttcggcaccgtggcgattgcttcgccggttgcaggattatagacgtgaaacgtttcgccgccggcagcatccaccggttctccgttgatgaccattttatacgcgctccgtttcatttcagcaggaaatactgctacttcttttgttatcggcatgcatgttcatcctttctgtttaattgcctttgtattccggttttcttttttcaaaaaatgcccggaccccttccttgtggtcggctgtttgccctgcaatccgctgggcgtatgcttcattttcgagcatttcatccaatgtgctttcaaagcttttttgcatataccgcttcacgaggccgattgcttttgtcggcatcgcagcaagcctttcagcaaaatgctgcgtttcctgttccaggtggcaggctggaaccactttcgttaaaagtccgtattccatcgcttctggtgcactgattttctcccttaaatttgcgcatatcattcacaaaataatggaggtttttgttttcgtattgcaatgcctgttcgtgttcaatccggcgcggctggcatgccccgataccggctgtaatcaagaccgtttttaaaaaatggaagcctgatcctgtttcgatgcgaaaggtgccgcggccggttttcttcacatcctgcaccgtttcgttcagcacaatcgttggatgaaattgcatggcttgttcgattaaccggtcggccaatgattgcgctttcacttttggcataccggttacatcataaatgtatttttcggggtaaagcgcggcaagctgcccgccaagttgcgacatgctttcaatgattttaactctcatttgccgcaagccgccgtaaaaagccgcaaataaaccaacaggcccgccgccgataatcgtcacatcataaacggtttcgtccatcaaccgccctcctttttatcattttaatttatataacgtttttaacacgttatatattgtttttgatatataaatagtagcatcggacatttttgctgtcaatattcgaattaaaattttttaaccatttttctgatgattcttttaaccggtgttttataagcgaaaaaaaacggagcatcactttgctccgtttttttctccattattccatttacaagccgcattttaattgcgcgccgcagttatcgcatgtattgcagccgccgatttccttaactttccctttccggcagatcgggcaggtatcgccgatttcgttgccgtatgtgacgtttgttgaccggatatccgggatggtatcaaccaggacgacatgctgtttcgcgtgtttgacttccgctttttcctgtttttcttcctgtggttcttctgctttcaatgtcaggacttgcgaatcccggctcccgtccacataaacggttccgcctttcgcgccgcccttatacaggcgttcgtacactttttccacctgttcaaccgtgtagccgcgcggggcgttgaccgttttcgaaatcgagctgtccacccagcgctggatgacgcattggacatcggcatgggcttccggtgcaagatccatcgcggttacaaaccagtttggcagatggtctttgtccgtttccgggtgcttatccagatactcctggacgatatccgcattgacctcgataaatttgccgaggcgaccgctgcggaaataggaaaaggaaaaatacggttccagcccagtggaaacgccaaccatggtgccggtggatccggttggtgcaacggttagcaaatgggagttccggatgccgtgtgttaaaatcgccttgcggatgtcttccggcatgtttttcatatagccggtttccgtgaatgcatggcgcaggcggtttgtctcttcttcggtttcacccgttaaaaacgggaaactccccttttcttttgcgatctcaatggatgcgcggtatgcttcggtcgcgattgtttcaaacactttgtcgacaagtttattgccttcttcagatccgtattctttttccatataaatgagaaggtcggctaagcccataacgccaaggccgacacgccgttccccgagcgcctgttttttgttttctttcaggaagtacggggtcgcgtcaatgacattgtcctgcatgcggacgccggtatggacggtttgtttcaattggtcccagcgcacttctttcgtttctttgtcgaccatttttgcaagattgactgctgccaggttgcagacggaatagggcgcaaggggttgctctccgcaagggtttgttgcgacgactttctggccgtatgcttttgcgtttgtcatgtcgttggcgttgtcgataaagaagacgcccggttccgccgagtaagtcgcgcagatgttaatcaaattccaaagttcttttgctttgattttgcgatagacgcgcactttgcggccaagtttttcccattcgcgcacatcgccgatcttatgccattcttcattgtatatgcgcatttcttcttcgctgtaattttccacatccggaaatttcagctcgaattctgcgtcttgctcaactgcttccataaattcttttgtgaggcagacggaaatattggcgccggttaaaaattccggattatgaacggtgtaatggccgcctgtttccagtttttcttccgcctctttcatgacttcttccgtaaagccgccttggcccggaatatgtttgtagttcacaatcccatggtacatttgcctttccatttcagagagcggcgtgaatttcaatttatcgtgggcaagcttgcggatccattcatcgttcgtattttcgatcaggaaacgcaaaatccgcggattctgcattttcgaaatgataaattcgacaatgtccgggtgccagacagccagcatgatcatttgcgctcccctgcgactgccgccctgttcgaccaggtgcgtaagtttggcgatgtcatcgagccatgagacagagccgcttgatttgccgttgacccctctagccagcgtattgcgcgggcgcagcgtcgaaccgtttgtcccaactccgccgccgcggctcataatttccatcacctgtttacggtgttcggaaatgccttcccttgaatccggtacaaacggcatcacataacaattaaaataagtcacttccgtttccgagccggcgccgtagaggacgcggcctgccgggataaagtttaagtttaccagttcattgtaaaacttctcaaaccattctttccgtttctcttctgttttttccactgccgctaagccggttgcattccgttttgcgatttgttcgtagtagacttcaagaggcttttcaatgatatcaagcgaccttttgatgacccccgtttctctttcatccgggtgttccagcgcctggcggtaatcttcttcaattaagacttccgcttcatttttttcccagtcgatccctttaatgacgccgagccccctggccggaaatttcgggtcttctttaatcgtgaggacaacaaaatcgcccttgcccaatgtgactttttccgtgtctttaaacgcgtatctgtcaatcatgacaagccttgaaacgcctttgtacgtaatgttcatatccggtgtaatcggatggacctgcggaaataagcggatatcttcgttcagcttctccacattccataatttttctgtcgaagcaacagacataacgacaactccttctctatttctccatgcaaattctctggtggttctgcctcctttaaaatagcacaccgcagggaaaaattgcaagcaaaaatactagatattgtattgacattttgtttttatataccatatattgtgtttaggtcaaacctctttctttttgtcaaatgaaaaaaagaataaaccatgccgaaaatctgagaaatcccccgaaaaagcaggcaaatccgggcataacgaaaaaatttgccgcttgcatcaaaaaagcagccataaaaagcgcggcacaaaaggaaatagcgaaaaagcatgcctctggccgctaaaaaaacaaatgttcatttatctcttaaaattccattcatccgacctgtaccgcctgtctgccagttcttccacatacgcctgttgcgccggcgtcaaggtgtacggttccagccggatgccgagcccttcttcaaaccccttatggaaagcctcttttgcttccccgtatgtgacgggaacggtgcgtagttcattgattgcaaccgcctttttcttaaaactccgctgcatcctttctctcactctgtcattcggatatttaaacaggctgaacagcttgtcctcatccatatcgagcaaaatcgagccgtgctgcaaaatgacgcctttctgccgcgtctgtgcgctgccggcgacttttcgcccttccacgaccagttcgtaccagctcggcgtatcaaaacaaaccgaagaatgcggagaccttagtgcctcccgttctgcttccgttcgcggcactgcaaaatacgcctccaggccgagcgcacgaaatcccctgacaagcccctctgaaatgacgcggtaggcttccgtgaccgttttcggcatatccggatgcgcttccgacacgatcacgctgtaggtcagctcgtgctcgtgcaaaacagcccttccccctgtcggtcgccggacaaaaccgagcccgtatcgttttaccgcttcgagatcgatttcctgttttgcccgctggaaatacccgattgaaagggtggccggatcccagccgtaaaagcggatggctggcggaatctcccctttgctgtgccagtcaagcagggcctcatccagcgccatgttaaaaaacggcggacagtggcctgaatctacaaacaaccaggtttcttttcccatatgtacccctcttctttaaaatatcactttaccagtttaccaaaaaacgacgcaaaacggcaaagccccgctcaagtttgtgccggtttttccgctggtgcttaaaacagaacggttacgggcttttcaaacggaaaaagctgaaaaaatagcggtgacatgtttcttaaaaaaagattttgattcagaagcgcaacacgaatataatagtagatagcgcatcaggtaagaaagggggcacgaaagatgtcacaatcgtggtacacactcatcattgttattgttgcggtagtagcatatactctcgccagatactaccggcagaaaaaaatcctgaaaagcttgacggaagaagaattcaaggcgggttatcgcaaagcgcagctcattgatgtgcgcgaaccgaatgaatttgcaaacggacatattttaggcgcacgcaatattccgctgtctcagctgaaaatgagattaaaagagatccggaccgataaaccggtttatttatattgccagaacgggacgcgcaccgggcgcgccgctgaaatgctttataaaaacggctgccgcgacctttaccagttgaaaggcggctttaaaaactggacaggcaaaatcaaatcagggaaataaaaaatgccgcggcaatgctgcggcattttttattttactttttcacataacgcaaaaccggttttcgtgccgcccgcgtttcatccaggcgtttgacaatggttgtatgcggggcttcctggacgatttccggattttcctccgcttcttttgcgatttggatcatcgcgtcaataaaggcatccagcgtttccttcgactctgtttccgtcggctcaatcatcatgcactcttccacattgagtgggaaatacacagttggcggatggaagccgaaatcaagcagccgcttggcaatatcaaacgtccgcaccccgagttttttctggcgcctgccgcttaacacaaattcatgcttacaatggcgatcatacggcaggtcgtaatacggcgccagtttccgcatcatataattggcattgatcaccgcattctcggtcacttcccgcaagccgtccggccccattgaacggatatacgtataggctcggacattgatgccgaaattgccgtaaaacggcttcaccctgccgatcgattgcggccggtcttcatccagcacatagcggtcgccttttttcacaacaaccggcaccggcaaaaacgggatcagctcttttttgacgccgaccggacccgaacccgggccaccgccgccgtgggggcctgtgaacgttttatgaagattcaggtggacaacatcgaatcccatatcgcccgggcgcgccttcgcaagcacggcattcaagttggcaccgtcataatacagtttgccgcccgcgtcatggatgatctccgccatttcaaggatatgcgcttcaaacagcccgagcgtattcggattggtaagcatgagcgccgcggtatcttccccggcaatttttcttaagtcgtcgagatcgacaagcccttcttcattcgacttcacagtgaccgtttcgaagccggcaacggacgcggaagccgggttggtgccgtgggcggagtcgggaatgatcacttttgtccgctttgtatccccgtttgcttcatggaaagcacggatcagcatcagcccggtccattccccgtgggcgccggcagcaggctgcaaggtcacctcatccatgccggtaatctcttttaaatgttcctgcaagtcatacatcagcccgagcgctccctggacggtgctttcatcttgaagcgggtggatatgggcaaatcccggaaagcgcgcaaccgtttcattgattttcggattgtacttcatcgtgcaggatccgagcgggtaaaagccggaatcgacgccgtggttgttttctgacagcttcgtgtagtgccgcattaaatccagttccgacacttccggcagttccgcatcctgtttgcggacgtattcaggcggaaaaatgtcaaaagcgtccacttccggcacgtccatttccggcaagctgtacgcaatccggcccggtttggaccgttcaaaaatgagcggcattccttcatttggcatcacacacgacccccatttcttcagccaattggtcaatctcttcttttgaccgcaattccgtcacggcaatgagcatgcaaccggcaaattccgggtaatccttgctcacatcataaccgccgatgatttttttctgcaataaatgttcatttacttcttgaacactttttggcaatttcacgggaaactcattgaaaaaaggagacgaaaacgggatttcaaaccctttttccgccaatttcttttttgcgtactgtgcttttgccatattggccagtgccatttcttttacgccttttttgccgagggcgctcatggccaccgatgcggcaagggcattgagcgcctggttagagcaaatattggacgtcgctttattgcggcggatatgctgttcgcgcgcctggagcgtaagcacatacccccttttcccgttctcgtcgaccgtttcgccgacgagccgccccggcattttccgcattagttttgacgttgtagcaaagtagccgcaatgcgggccgccgaatgcagttggaatgccgaaaacctggcaatcgccggttgtaatatcggcgccgaaatcccccggcggcgcaagcaccccaagggcaagcagattggcggatacaacaaacaaagctttttcggcatgggccagttcgccgatttcttttaaccgttcaagcgaaccgaaaaagttcgggtactggacgatgacagcagctgtcccgccgtctatttgttttttagctgcttccagatcggtgcagccgtctgcgagcggtatttcttccacggtgatgccttttcccttggcataagtatgtaaaacggcccggtactccggatggacagcttttgaaaccaatactttctttctcttcatctgcccggccgccagcatggccgcttcagccatggacgtgccgccgtcatacatcgaggagttggccacatccatgccggtcagctcgcatatcatcgtctggaattcaaagatagcctgcagttcaccttgcgagatttccggctggtaaggtgtataggccgtataaaattcggatcttgagatcacatggtccacgaccgttggaatatagtggtcgtaaacccccgcccccaaaaaagaggcatattcttttaaattggcatttttccccgcaagttctgacagttcttttaacagcgccgtttccgattttgcttttttgatccggtaatcccctttaaaccgcactttttcgggaatgtcggaaaacagttccccgacgcttcggactccgatcgcatccagcatctcacgtttatcttcttccgtcatcggcaggtagcgatgcatcacttttcccctcctccgttttttggctttttatagaacggtgtttggacaacgacggctttaatctttttggaacggacgtccacttctacttcggtgccgggtgcgtcccacggtacacgcaaaagggcaagaccgatatttttctttaaagtcggcgactgtgtcccggttgtcaccgtgccaatccgctcatcccctgcataaacgctgtatccgtggcgcggaatgccgcgaccgatcatttcaatcccagcaaggcgccgtttcaggccttctgctttctgtgcaaggagcgcctgcttcccgataaaatccgcttccttcttaagctttacagcaaaaccgatgccggcttcaagcggggaaatgtcttccgccagctcctggccgtaaagacagagcccggcttcaaagcggagcgtatcccttgctccgagcccgcacggcaaaacgcctttttcccggcctttcgccaatatctcatcccacagcttcagcgcatcttcactgcggcagtaaatttcaaagccgtcttcgcccgtgtaaccggttcttgaaagcaatactttacaaccggcaacctttgcgttttcaataaatgaaaacgttggaatggagaaaacatccgcttctggcgcaagtttttgcatcacttccgtagcaagcggcccctggagcgcgagctgggcaaccgatgcgctgatgtccgttatggaaacatcctccgtccggtgtgaaacaagccacttataatctttttccgtattggcggcattcaccacgagccaataccggttttcgcccaattggtaaaccagcaaatcatcgactgtgccgccggcttcattgcacatggcggtatattgggcagcacccggcttcaatttggacacatcgttcgtcatcattttttgaagaaagccaaggctttgaggcccctccaccaggatttcgcccatatgcgaaacatcaaacaggcctgcccgcgtacggacggcttcgtgttcggctttaatgcccgaaaattgcaccggcagttcccagccgccgaaatcggtcgtttttgcaccgtatttccggtatacatcatataatggcgtccgttttaattccggcattcgtacccctccattttgttttttatccggacgtggatccgggggcaaaaaaacagggaatattccgcctgcttcacgaaatattccctgtccttgcacctgaaagtttaccgaaagacggttttcccctttggtggcttcccgaaaagaagcgctctccagagatgcgtcaaattaagagtctttttgcctgagagattcacgtttccgcttgctccgtcggcgctgcaaaaaatgcagtctctcctcttattctcatccgccaatattcagttcaaaatcgggcatactaaagttaaaatgcctgatgcaggctgttcgatacgatttttccctgtataacctgtaaaaactcttgatcagtttcatcgtatcatgacaccattctgaaaatcaattgaattttttaaaataaaaagcggctgtaagaaatcgaaaacgatgatcggggacgattggaaaaggagtgcaggcagcatggaagtcaacattgaatttgaccgctcatgggaaacgggattgatggaacgctatcaggacgacgggccgtggggaaaatgggaactttataagcttgcagtggaaatggaaaaacggctggtcattcctgaatttgaaggattgcaggcgccaaagcatctggccaatgtcaaaccgcttgcgcaccagctggaggttgcccgccaggtcgttgaaaaaatgaacggcaaagccattttggcggatgaagtcgggcttggaaaaacgattgaagccggccttattttaaaagaatatatgattcgcgggctagcaaaaaaagtgctcattttagttccggcgtcgctcgtatcgcaatgggtcgcggaactgaacagcaaattccatatccccgctgtcgggcaaaagaaaagttatatgtgggagcagtatgactgtgttgtctcttccattgacaccgcaaaaagaagcccgcaccgtgacatcatttacaagcagcagtatgacatgattattattgacgaggcgcataagttaaaaaatccgaatacaaaaaattacgcctttgttcaaggcttaaagaagaaattctgcctgcttttgacggcaacaccgattcaaaaccggatcgatgaaatcttccaccttgtctcccttttaaagccaggccatttaggcagcgaatcgaatttcagcaaaaaatataaaaaaggggacaggcaggtgaaggaagacgaacatttgcgggagctggtcagcaaagtgatgatccggaaccggcgcacaaacaccggggtggaatggacaaaacggcgcgttgaaacggtgctgattgacttcagtaaagaagagcgcgaactgtatgacgcgctgcaaacgatccggcaaggcagcgaatcgtacagccgcgccggcttttcgctgttgacgctgcagcgcgaggcgtgttcgagccgggaagccgtttttgtaaccttaaaaaacctgctgaaaaaaacggagcagccctcgcccgttttagaagaaaccgttgctgcgctgatccagaaaattgaagcggtaaaaaccaattcaaaagcggaaaaagcgctcgagctgatccaaaacattgatgataaagtgattatttttacggaataccgggcaacacagctttacctgcaatggtttttaaaacaacacggcatttcatccgtcccgttccgcggcggctttaagcgcggcaaaaaagactggatgcggaagctgtttgaaaaccacgcccaggtgctcattgcgacagaagcgggcggtgaagggatcaacctgcaattttgccaccatatgatcaattttgacctgccgtggaacccgatgcggctcgagcaaaggatcgggcgcgtccaccgcctcggccaggaaaaggacgtgcatatttacaactttgcgaccaaaaatacggttgaagaacatattctgaaactgttgtacgaaaaaatccatttgtttgagcgggtgatcggggaactcgatgaaattctgacccggctcgaattcggaaaactggaagaccatctgctggatgtcttccaaaactcgcaatcagaaggcgaaatgaacatcaaaatggaaaatctcacccaaatgatcgaatttgcggaagcgatacggaaagaggaggggcatgcggatgctgcaggaagaaatacatcaatatcttgaacgcttttttgaagcaaacggcgctgtattggttgaaaaccgccccggctggatgacggtgcaattaaccattgaactcgataaagcgttaatgaaccggccgttttactggtcctatcttgaaaaaacaggcggcatcccgaatccgatgaccgtcacgttcattacggaccgggaaaaagcaccggatacggtgaaaggagagccggtccattttggaagcccccgcctgaaccagattttcgagacggcaaagcagttttcccgctatatccgcctgtttgaagacgtccatcccgggcagaaacaggtgccgctttacccttggcttgggatgaatgttaaaatttcgtaccgctgtgatttaaaaaaagatgtgttccgttcgatcgggttgaatttgatccacggcacaatggctgaaaattttcaggacttgttggagcagcggacgctggcgccgaaaattccggattattgttttaccctgacgccgatcatcatgctaaaaagcgccgtcaaaaggattgaacattatatccggcagggcctggcgaaagagccgcatcattgggcggaagaagcggtaaaacggtggcaccaggatctcgcgctgttggaccatttttacgaagatatggaagagtgcccggaatcgtatgaaattgaaaaacaggcgctaaaggaacagtatgagccgaaaattaccgttcatgtcctaaacggtggcctcttttatttaaaagatgcgtttatataagcaggcagcccgcaaaaaaggctgcctgctttctactgttttcttttgaaaaagaggaaaaaataagggaggataccgaaccatctttcggcaaaaggcggcatctcttcctttttctcgttccgctttttctgccgctcgctttttggcgtgctcacatgctgcatccatgtttgtgtcagcaatttgacataatcatttgtcgacattggcgccaccgtccttacaggcgccagtatacccgaaagcttccgtttttatgcggccggaaatttccgcaacaatttccgccaccgattttcccgtcgtatcaataaccaaatcggcacaagaaaggtaaaacggccgcctttttttataaagggagatgatctcctcctttgtccttcctgctgcaacaggtcttgaggggtcattttgaatgcgtgaaaccaatatttccggatcgcaatccagaaaaaccgtcacgccgtctcgttttaatagacagacgttttcttcccgcatgacaattcccccgcctgtcatgatcacccctgcaagcgatgtggcccgtttcagcatctctgtttctttccggcgaaaataggcttctccttttacagcgaaaatggcagcgggcggcattccttcctcttcttcaatccagcggtccaagtccgtcgccctacttcccaagagcgaggcgagcgcatggccgacagtcgtttttccggcacccataaacccggtcaaatagatccttttgttcatcgttcctcccattgaaacacctttttttctgtctgattatatcgtatcgtacttttaaacggttcaccactctcattttccgcagttaaagaaatcactgcagtatctccgtcctgtttgatactgtaagacacctttccgtctgaaaaacggagttcccccgggcttttgtcgcctttttccaatttttgcgccgcctccctaatggcgaaaagcgacatggtattccgcaaataatattccttcaccagcacggcatatttcttttcgccgagataaatgtccgttcccgaaatgaccatactgcatgcggcaagcgccaaaaacagcaccactggcaaaataaaccctttttgcctgttcatcgggcaacgccttccgattggccgggatcaaccgcatggcgggaaagaaaggtcatttccgctgttctttccgcgccattcggataaacggcggccactttgaccccgtttcctgttgccgcaaattggatggactgcacattttgaagcacaatttgatgcccttcaccgtccactctccgccgcagactgttctggtatggttcatacgtaaccgtccttcctgcctcgttcagtttcaaagtattttgggctgcctggcacgaggtgcttatccggatttctttacgcaactgcatgagaaaaagattccactcttcatcttcttccggccggaatgcttccccggctgtcccgaatgttttcactgccaggggaaaaagtgagaacaaggaagtgacgagaagcagtacgcacacgctttcaagcagcgtaaagcctttttcattgctggagcgaaacgcaagtcgtgttttgttcatgtttgacacatgcctttctgccattgtctttgatttgaaatgtccatgtggccccgcccgcctttttttctttttcaacgacttttccggtaaaagtccattcctccgttttttcgtataaaaaacgggctgcctccatctcttgttttgcctctttgatttgaccaagcatatggagaaacggcgggaataagcaggccgccatcaggcaaaatacggcaaacgcagcgatgacttccggaaaagtaaagccccgttcattcttcgacataaaaccgcccacttccaatatgcgtaaccagcttgatttgttcttggccggactggaaatagagcgtgccgaactgggtgacattcccgtccggcccaattgcataggaatgaaagctgccgttttcgaacattttgatgccttccggaagccttctttttataatcgtcgcatttttcctcgcttcgaaaatggagtacatattgttctggcggaaaaattggacgtatacattcgtctggcgggaaatcgcgtccgtttgcgccagatacaaatcattttcaagctggttaatgaacatttttttgacgatcgtatgtttcaccggcttaaaaccggcaaacgcaagggcggtgatcacggatacaatcaacaaaacaacgagcatttccggaaaggtaaaaccggcttcattttttggccgtttcactttgcaacctccgttactttcccgtccgccccgatgttcactccgtttccattcgggcagctcgttttcgatacatagccgccgtcttttaactggttgatagatgacggatattcattgtggtccatttcatacgcctgcacctgtccctgcaccatcgcaatgaacgcatcgcagcctttattattgatcgcatcggtatgcttggaaatgttcggaatcatcaaaaacaagagaaccgtaatgacgagcaaaacaatcagcatttcgatcagcgtaaaccctttttcatttttgataaaagacatgggcaatttctcctttctttttttagggggaaggcttgaagccccgccatccggcacgccttccccggttaaaccgcgtcaatcatctggaacatcggcagcatgatcgacaaataaatggcgaccaaaaagaaaccgatgaaaataaacacaaccggttgaatcagcccgaacaggctttggattttctcttccattcttttcaagctaatttggctgtaataatagagctcctgatcaaggcgcccgtttttctccccgtggcggaccaaaatgaccagctgtggctcgataaacgggacagaagccagggcccgggagaacgtctcaccagcaagcagtttttcgcgcaaatattttgcagtatcgcgccaaagcggcttaaaattttgcgattccatgacatgcaaaatttcatagacggaaaaaccgcttttcagcataaagctccattctcttgccaaaaactggctgtaatagctggtatagtaaaagcgggataccggcagccgcgaaagccacgccgcctgcctcagcggtttttttcgtttaaaatagagaaaaaagagtgtgaaaaataggaagagaaaaatacttgaaaccaggataacatgcggggcctgttccatgatagtaaggaacagccggagatttcgcgaaggtttgtagtccattgcgacatacatatgttcaaattgcggcagcagcacgtttctcacaaaagccgtggcgataaacagcgcggctgccaatatgagcggataacggatcagtttccaaaaggcaagggcatcctcatgttttttcaataagtaggcgcccgcctctttaagggcagcaaccatctccccgtgccgtccggcaaaataaatttgcatgcatgcattggcatcaaaccggtgtttcagcagcacgtcatggagcggtgttccgttttgcagctgtttgttcatggaacgcgcatccagttcgccgtccacatgcccgagaaaatcgatagcatctgcaattggaaatccgttttcgagcatttcaccgacccgggtaagaaagcgcccctgcagtttgaggcttatccgcttcttcctcttcggcaatccagcggtgatactcttcttcagaaatgtatccaagcacaatcccctttctgagccattctttcagtgtcggataatgatagtagacctgttccccctttgcttctttcagcactcgctgcaaatttttcccgtacagcagctcatataccgcggtttgccgcttttctcggctgcgtgggcaatcttgcgaatcatgcggacagcggatcccaccgcataccgggcatcgcaatgtaatcagccgctgtgcgctgactgcgagcaaagtctgctccatttcgtggatgctcaccccaaattccatcagcctgtaaatcgcgccctttgcgtcacgcgtatgcaatgtcgtcagcacgagatggccggtgagtgatgcgcggatcgcaattcttgctgtttcggcatcacggatttcccccaccaggataatatccggatcatggcgcaaaatcgctttcagccctgtgctgtaagtaatacctgctttttcattcacctgtacctgcaaaaacgagtcgctttgtttttcaacagggtcttccagtgtaatcacattccgtaaaaaccgttttgcgcagtgctcaacaagcgtatacatcgtcgtagacttgccgcttccagtcgggccgctgaaaatcagcatcccatgcgaatggttgagcagcgccattaatttttttgtgctcgatggaaaaagtgaaatttggctgagctggaatttttcttcatggggcaagatccgaataacgaggctctctttggaaagagaggttggcagcgtcgaaattcttaaggagatcgtctgctgcaaaacattcatggcgaacgacccgctttggggtttccgtttttcactgatatccatggaagacataaatttcaaatgggatatcagcctttccccggctttcgcggaaaggttgcggtgggggtacagccttccgtactgccggaactggacatggtaatgcttttctttcggaacgatatggacatcggtcacattgttttttaccgcctgtccgatcaaaagttccgcaattttttcaactgacataatccatcacataccacctttctttttgggatattctctcatttcgacacggctttcaaaattcctgctttaaaacaaaaattttttcgctattttttctcttagcgacaaaaaagtgtgtgatttttgtcacaaattttggcgttgttatcatttataatataaataggataaaaaatatagaggtgtttcatatggaaccaacattaaaagtgatcaatgccctttctgacccgacccgctactcgatttaccaatttgtactgaagaaacggagcgaagtatccgtccaggaagtggccaatgaatttcatattcatccgaatgtggcaaggctccatttgtccaagctcgaagatgttaaggtgatttcatctgaactgaacaaaaccgggaaaggcgggcgcccggcaaggctgtataaaagctctgaacaagtggtagaactctccttcccgcaccgtgaatacaaattgctgtccaacattttgcttgaagcaatcaacaaaatgaaactggcagatgcaggccttttgaaagatatcggccgggagtacggaaaacggatcatcgaaaacatcttaaaaaacatgaataaaacaaaagaccagctgacatttaacgaaaaattatctgtgctcgcaagcgtgtccaccgtggacggatattgcatcgaaacgctggaaacaacagacaagaacgaactcgattaccatgtatacaactgtccgttccgggaattaatccatcactcggcggatgtttgcgagatgcatgtcgcctatattcacgggttgtttgaggcactgtttgacgatttcgacatcaaccagcaggaaacgatgctccatgattgcagcgaatgcatttatcatgtgaaagttgctaaagttgcgaattaagcaccggttgtgtttacaccccttctttattcctttataataaaacttgatggacataaaaagaaggggtggttcatttggatcgtatgtaccgcgtactgggtttctggactggtgtaatggccgtcatgttttttctcggcggcatgaaagaaaccgctttattgtttctggcccagaccggtttctttgtgcttgtcagctacttgaaactgtccgaacgcatgtatatgtacatctttggggcatatttaacgattttcttcgccggctttacgtactacaccacgtttatactcacacccggcttcggcgaataacctgttcctcttaaaatctgcttgcttttttcttgcactaaaaaaaccggcagcgcatgccggtttttttatccctccaaaaacgggttggagtctttttccgccccgatcgttgtctgcggcccgtgtcccgggagcacgatcgtgtccggatgcaaaaccaataattttgtatgaatgctttccagcaaaacgccgtgattcccacccggtagatcagtccgtccgatgctgccggaaaaaagggcgtcccctgaaaaaacaatgttgtgttcaggcagccagtacgaaacactgcccggtgaatggcccggtgtttccagcacgtgaagcgaaaaagcgccgattttcaatatgtcttccccggtgatcagcttttccgccccgcgcgcgctgatttctcccatcccgaaaaaataggacccgttttgcccgggatccccaagccacatctcttccttttgatggacataggccgggatcttgtacgcatcccgcactgcatcaagagcaccaatatggtcaaaatgggcatgcgttaaaagcaccgcgtgcggtttcagcccattttccccgataaaagcatgaagtctgtgaaattcagcgccggggtcaaaaatcaaacagtctttttcgtcattccacaggatatagcaattcgtctgaatgggcccgaccggcaattgtttccatttcattcgtatccctcctgtcctattgtatcatgttttcatccgcaaaaaatgcctgttcatttactcgacaaatcaccagactggttgtaaaataaagataattgaatgccttttcattataagggggatgtcatgggtacagtcattattttcagtctcgtctccattctgtcactgattggtttcattactgcggccaaaaacaaaaatatcctcggatttattttcggtatcatttcttttgcccttttcggctggtttgccatcatgaccgtcatccattcgggctacccgacctttacttaatgcttaaaaaagcggcgccatgccgcttttttgcatctttgcatcaccaaaaaccgaagcaagttcccgtaattcaatttgtcttaaagcttagtgcgcgctagcacacaagtttgcaacaggctgcccgtctctagatgattcagtccaaaaaaaccatttctttttctctgcagcataaagacttgcgcaaaacggccataccgcccttgtagtacggaggctggaaaaaaactcctcttttcagatatcgctgtttctcgtatggcaaaatcagcgcgtatcatgaaagagggagctttccttatattttatttaacgccaaccacgctgccccgagcacgccagcatcgtttcccaatgtggcaagttccagttttgtcgatttgccgaccgtgttgaacgcgtatttcaaaaaataagcgcgcactgggtttaagagcgtttcgcctgcttttgacaccccgccccctaacacgattttttccggatttaacgtatttgccacacttgccagcgcaagcccgaggtattttgccgtttcgtccacaatttcacaggaaagggcatcgcccgctttcgcaaaatcaaacacatctttagcggttaccgagccgctttgggcatacaaatcttttaacggagacgcgctgctaaatgcagccagtttcgccatggctgtcctgaccacgcctgttgcagaagcgaccgtttcaaggcagccggttttcccgcagttacactttgccccgccttccggaataacggtaatatggccaatttcgcctgccgccccttttacaccgtggacgatgtcgccgcctgtaatgatgccgccgccgacaccggtgccaagcgtaacgaagaccatttccccggaacctttcccggcacccttccacatttcaccgagtgccgcaacgtttgcatcattatcgatcaccacttttaaccccgtccatttttgcaatgtcccggcagccggataatgctgtgcccagccgatattgacggtttcatagatcacgccggcttccatatcaaccggtcccggtacgccgaggccgatccctgtgatatcttttttctcccgctttacccgggccaattcgtcctcaatcgattttgcgatattcggaaggatcgcttccccctggttagccgtcacagtcgggatctcccatctgtgtaaaatatcgcctgcttcattcacaaatgccagttttgtggtggtgccccccaaatcaatgccaatgatccatttctcagccatttcgctcaccctcaatttttttctctttttccaaccgtttttcctgcctgatgatcaacagggcggtttcgtattcgcggttttccagcacccttgcctggtacaattgtctcagttccaattccatcagctcgagatcggcaagccggtccccgatatagacaataatgccgaattttttcaaaagctgctgcacatcataaagcgttctcatttcgacccagctttcgtttgataaaaatctgttccaaagaaaagtataatcgattgtgcagcttctaacaagcatcaaattgcggcaatttgccggatcatttggccgctcggcatggaagtgcgctgtgaaaccatgcccggagcattttttgaagaatggccgtgacaacccgcggtctcaaagagggaattttttatcccggcagaattcgtcccccgaaaggcccgcgcttgcacgccaaagaagcgggccggaaccgaaacggggggcatactttattagacgccgcgcaggcccttataaacgaggaaagcggcaagaagaagagccggaagctgtacaccgatgcgcttccgtttcggaaagtggacgatgcatgctgcgagaaaaccgccgaaaagcccgccaagatgcccgaaattgtcaatgccggaaacggagaagccgaaaacgagattaatgatgatgagcgtaatgacactcgatcccattgtccggaaaaaaagatcgcggtaagccgtcccgatgtaaagcaaagcgccaaacaagccaaaaatcgcaccgcttgcgccggcagaaaggcttggcgaaaacaggaagctggccaggcagcctgtaaacccggcgaacaaataaatcagggcaaaacgcgccttaccgtaaatccgttcgacaagcggcccgatgtaatataaagagagcgaattcataaaaaggtgcatgatcccgatgtgaataaaaaccggcgtaatcagccgccaatattgcccttccataatcagcgggttgtacttggcgccgaaacgaatcaggttttgcgtattctgcgtcccgccggtaagcgacatgataataaacacggcaatctgtacggccagaaagacgtatgtaaaaaacggcctgcccgcatcaaacagctgccgttcctcctcttcccgttgcgcctcggctgcgaacaccatccgctgtaatgcataggggtccccacccatggtttcgggcgcaatcgcaagccggccttccgtaaactgacgcagcttgctgatcccgggatcaggattctccccttcaatcaatacgctgtggagttccgtttttccgccattaatatgcatcggttcatccaaataaatttcataatcgtcaaccggcgcatacgcactcacataaatattgagtacgcgcggagcaagccgtcttatttgtttgcataaatcttcagcctgtgcgcaacaatcacggatgtcgcggtacaaccagttgccccagtcgatgtcataccgcaaaaggcgcacaagcggcaaattcttcttttttggattggcaagccacatttcatcccggttttcactcaaaaacatgatccggtactcattttccacgacaaaatggcggctgattgcccaaaacaaaacatctgccctgctgttcacgatttcccctgcctttttccatccattttatcctaactatatcgaaaaaaagagcggagtgtaaagcgtttggccttttacacccgccctttttcgccgttattgaaaaatctggcccatgacgcgtgaccgcaatcctggaatccgcattgctgccgtgaccgccaattttctcgcagggccgtaccccaatacagtgtttaatacccggtaacggttccggtaagctgctgaaaacagaagcagtaccgccatccacttcagccatctgttcatggcgattcccccccaaaaaaattttccgcaactcatttctatttttcctgccgggagaaaaattatccgctatataaaatgagcgaaacatcgctactttgttgccggctgcaaaaagaaatctgtgcaaatggatgaccttgtttcaatgtaaaaacttcagttcattttatatgtaagtcccggcaaaagaaaaaacagcaggaaaacgcctgctgtttactttgtttcgcgatgtacggttgcacgtttgtcccgcgggcaatattttttcaattcaatacggtccggggtcgtacgtttatttttcgttgtaatatagttacgctcaccgcattccgtgcaagccagtgtaatgtttacacgcatgtttcatccctccatctttctcaatcgatcgtgcatacgacttatctatcatagcatttttcacagacgattgccagtatgttttttcgggcaaaaccgttcttcccgccggctgccggtataggtgaaattttcacttgaatgggggcaagtccgccgctcccccttttcttgcacgatttcgccccctcttgccagaaaggcggtacacttcaccggaaaatcgtgatataactaacaatagtactttgcaatgaaaaaggagagaaatggatggttatgacgctgatggtgttactggcgctttctgtggtattgtttcttatttcgtttttccgccaggaccgcgtgcatctggtagaacaggaactggaagatttgtctttaaaatttttccaggaaacgtaccagatcaaaaaaagattacagacgctcgaagaagaattcatggcgcctggagccgacccgcttcttccggattcgtccggcgaaaggatgccggtcaatgaaattgtaaaaaaccaggtgctcgctttgttccggcaaggtctttcattcgaacagattgcaaggcagtccgccctccctgtaaacgaagtgaagcgcatcattacgggtgccatggaatagaaaacggatagcgggaaaccccgttatccgtttttgatcgcagccattagttcgaaccgcctgccccgttttcggctgttggtacggccgtgttggcagcatggctttcttcttttttcttcaggttaaaataagctttaaacacacggttcgcaatctttaaatttgtgtgcgggtcggatgcgcctcccatgtaagaccatggcacaacaaccgaaatggcaatttccgggtgattgtaaggcgcataaccgacaaaggtggaattccatgcatctgaccaaatggaaggatgtgcccttccggccgcatcgtatttttccaccagttcaccgccataaaccgcctgtgccgtcccggttttccctgccactttcagactggaatcaatccgcccgtaagctgttccgtggggaacgttcaccacgttataaaaaccttgtttgacgcggttgatgtatgactccttcatatccacacggtttaagaccgtcgtgccgatttctttttcgacaggcccgagtgtcttgccgtccgggctcggttcacggatttccttcgcaatatgcggctgcacgcgataaccgccgtttgcaatcgtggaaacatactggcagagctgaagcgcagtatacgtgtcaaactgcccgatcccaaagtcgagcacgttcccgctgttcggcgggacttccgtttgatagccgccgacttcacccggaagatcaataccggttttaacacctagcccgaattgggcaaaatatttgcgcaatgtccggatcgttttcattttgtcaatattaagcgagccattcggtacataattgtgctgcccgccgatcgccatgaccgtccggaacatatatacgtttgatgaaacctgcagggcctttaagtcgttaatcgcaccaaaaccagacgtcacccacgattttttcacaggggtgctggcgaaatggagcggctggtcgacaaatacactcccgggcgaaatggccccggtctgatacccggtcaaaacagtcgcacctttcactgcagaacccgaaggataagcagttgtcatattcccaagtgcaaagtccttgattttcgcagacccgttttttgtgaccacctgcttgccggccattgtcagcacttcaccggtattcgggttcataacggtgacaaaggcacggtcaacaagcggattgcttgcgcgggccgctttgatttcatcggtaataattttttcaacttctctttgcaggtcaatgtcaacagacaaaacaaggtcgctgcccggcttccctttgctgattacttttgaagagatgacatttccttttttatcctgcttcgcttccactttttctttttcgccgtttaagacatcttcatactgctgttcaatgtaacttttcccgacgcggtcattgcggctgtatccgcgggccgtgtagtactgttccttatcggcaggcaggccttctttttcggttgtcacatcgccaaggattgaccccaaaaccgaatcgttgctgtttgcctctttgaacacatagttccgctcccagtcggttgtaatatccacgcccggcagcgctgaaagattctcgctcacagtcgcatactctttattcgtcacgtccgtgtttttgataatttgcggggacagcacatagccggccgacattttgctgtagatcgcgagcacattgagatcatcccgcgacagtgaatccagatcctgtttcgtaatccgattcagctgcaacttgtatattttgtcgctgtcgttgtcgagctttgcctgttccgctttggaaacgagctgttttgccgctttcggatgggtcaggatccaaaagtcttttttatcccggtccgttagccgtttcacatccgcatccggcactttgatgatttccccgagtttccttgccactttcagcattttcccgttgtcatccgcctgggttctcgtatatgtgatcgccttcagcgctttattgcccacaatcactttatagttccggtcaagaattcttcctcttggaacagaagtatggatcgtcttgtcttccgtctgttcaagttcttttttgtaatcctggccgtagacaatctgcacgatgcccagacgcacgactaagaccgaaaaaagcacaaaaacagcaaagaacagcatattcattctaaatggaatatgcgaccgcttttttcgcttctttttcttcaacctttttctgctcctcccttcgccatcggctatacatttcattttagcgaaaaagtgcggacatggctataaaaaataccgccatttttggaaacggcggccttacatatccccaatccggatattccttgtaaaaagcgaaatgcataaatgccctgccccaatcacaagcatcagcacgcggatgcttacctggctgttgaaaaaagtgacggctgcaatgaaaagcaaaatcgaagcgactctgccggcattggtaaatatttcaagcacgacaacatactcaatccgtgcttccgctgctttccatgccctgccgatcacatcgtatgtcatcgaattatatgggacaagcagaagcgggtaagcaatcgcaatcgttgcggcataaagcagcattctcggataggtgacttcaaaaataaacaaaaacacggccgcatacagaagcagtccgcctaaaaaaatggagcgctggcggtgtttgatttttatataacgggcaacgagcgtgtacccgagaaactgcaggcaggaattgatcaacccgaacgtgccgagagaaagctcgctccccgtggaaaggaacacgaaaacggaaatcataaacacaaacgtgccatcccttaaaccttgaacaaaatgggcgcttgtaatccgtttccaattcgggttgcgatgccgttcctttacgatttgcttaaacaaataacggccgtgtgcaggtcgtggtgcaataaaaaaactgaggacgacggcaagagcaaacaggatgagggagagcgcaaaaacgaccgtataaccgcttttcccgatcgctgaaatgatcagcccggcggcaaacggtccggccatgccgccgatggatccgaatgcccccataaagccgttaaaaaaatccctcgtctcgggctccgtaatttcaaacgtcagcacgttataggcgagccagtaaaagccatagccgatcccgagcagcccgccaagcaaaacgataaaatcgccggcatgcccccgcgaaaacagcacgcttaaataaaacagcgccaaaaaggcaaccccgatcctgaacaccatgaccctgtccacttttttcgcccatcttcccgcgatgataaaagtgagcggctgcaggataacaaccgataaattatataccgccagatctatgtacttccctgtctgcttccataaatatatgttaacgaaagaattggacagagaaacgcttaaagaataaagcccgccgatcgcaagcagcagcagcagatcttttgacagttctatatctccgaaccatttttgcacatgcttcataaatcaaaactccccccattcccctatattgttttgaaaaacgggggcgtttatgcacgagcgcatgcaaaaagggcgtgcacgcaaatggcgcggcacgcccttttttaaatggatcgcgattatttcgctgcttcgtacagtttttccacttcgtcccagttcacgacattccagaatgcagaaatatattctggacggcggttttggtatttcaagtagtaagcatgttcccaaacatcaaggccaagaaccggttttttgccttcggaaagcgggttgtcttggttcggggtgcttgtaatttcaagctcgccgttattgacaacaagccatgcccagccggaaccgaaacggcctgctgcagccgctgcaaattgttctttgaatttttcaaagctgccgaatttgctgttgatcgcgtcaagcagcgcgcctttaggttcgccgccgccatttggcgaaagcaacgtccagaacagcgaatggttggcatgtcccccgccgttgttgcgaaccgctgtacggatttcttccggaaccgcattcaaatccgaaattaagtcctcaacggatttggaagcaaggtcgtcatggccttccaacgctttgttcaaattggtgacataagtattatggtgcttcgtatggtggatgttcatcgtttccttgtcaatataaggctccagggcatcatacgcatacggcaattgcggtaaagtgtacgtcatatctttattcctcctttatgtagtgttttgaaccgaaaagattcaaagatttgtcatatttaatgtaccaaaaccgattgataaatggcaaatttttcgcctgcatttttgagaatcatcccgggttctaattacagcataccggcatatactggtagcactcataaaaggagggaatgtccatgttgaaaaaaatatttgcgctctttatcgttgcccttatctcttacagcatctactacgatctccacgcaggcacaatcccgacgaatgctaaagaaacaaccgaaaaaaacgttgccatacaacctgaaacaacccacggtccgtatgtcacagccaaggtccattccggtgacacggtgcttacgattgtcaaaaaaatatcaggcgggacggcgccttcgattgaaaaagtgatccgcgatttcagcaaactaaacggcggaattgcaccggaagacatccaaattggacaaacgtaccggtttcccatttacggcgaatcccggtaaaaaccggagtatggcttgtcaatcggggcagtaaattggtaaaatgtaagttggtaaaatgtttatggactgatagatcattaaaggagcgaatatccttgggtgagatcatacaccgtacaaaaacgcgccctgtcaaggtaggtaacttgacgatcgggggcagcaatgaattattcattcaaagtatgacgacgacgaaaacacatgatgtcgatgcaactgtccgccagattgagcggcttgaagaagcaggctgccagatcgtgcgcgttgccgtcccggatgaacgggcggcaagggctattcccgacataaaaaaaagaatccatatcccgcttgtcgcggatatccactttgattaccggcttgcgttaatcgcaattgaaggcggcgtcgataaaatccggattaacccgggtaatatcggcaagcgcgaaaaagtcgaagcggtcgtgaaagcggcaaaagagcgcggcattccgatccggatcggcgtcaatgctggaagccttgaaaaaccaattttgcaaaaatacggatacccgacagcagacggcatggtcgaaagcgccctgcaccatatccggattctggaagacctggattttcacgacattatcgtttcgatgaaagcctcggatgtccgccttgccatcgaagcgtacgagaaagcggcccggacatttgactacccgctccatctcggtattactgaatccgggacgctgttttccggcaccatcaaaagtgccgccgggattgggacgcttttaaatatgggaatcggcaacacgctccgcatttctttaagcgccgacccggtggaagaagtgaaagtcgcgcgtgaactgctgaaaatattcgggctttcctccaatgccccgacgctcgtttcatgcccgacttgcggccggattgcgatcgatttaatcagcattgcaaacgaagtcgaagaatatttacagaccataaaagcgccgattaaagtttccgtcctcggctgcgccgtcaacggccccggtgaagcaagagaagcggatattgggatcgccggtgcacgcggggaaggcctcctgttccgcaaagggaaaatcatacggaaagtgccggaagataaaatggtagaagaattgaaaaaagaaatcgacatgcttgccgaagcgtattaccaaaaacaggccgcgcaaaacgtgaaccccgtctgaccgaaacaccggcgtaaaacaagccggtgtttcttcatgcgcggcaacttttatcttccaggcctggcccggacaacaggcggcacgatcgcttcacattcaaaacggaaaaggaggcgcaccatggtgaaaaaataccgtttcggcattgacattgacgggactgtgacagatcctgaaacgcttattccgttcattaacgatgcctttcacattgacctgaaatatgaagacttaacgaagtatgagatcacagatgtcgtcgatattcctgccgggacatttgccgactggtttatccgctcggagcctgtgatctatgcaaaatccccggttgcaaaaggggcaaaagaagtgttaaacaaatgggcagaccggtttgagctgtattttatcagcgcacgcgcatcctatctccttgatgtgaccaaaaactggtttacaaaacaacagctgaaataccatcatatcgagctgatcggcacgcatcacaaagtggaaaccgcaaaaaagtacaacgttgatttgtttttggaagacaaacatgacaatgcggccgccattgcgcaaacgctcggcatccccgtccttctgtttgacaccccatacaaccgggatcccgtcccggacaatgtataccgggtgaaaaattggaaagaagcggatgactgggtcagacgctggatcacccagtccagccgctccgcacgcgattaagggcttatccgggtttctgtaagggacaggctgggttgcggatagctttttgcggtgacccgcgtgcctgcgcccgggttatttttcccggaaggcgtcttgaaaaatatccaaaatcataaaatgaacttcagtttttcgcgccaacatctactacgatcaggatcgatatggattctggcaacacattcgttcaacttatatagcaaaaacaaaccctgccggaagcagggtttgttaaatattttgccgcgtttcatctgccatgcattccgggcacgtgccgtaaatttcaaacttatggccggaaatggcatacccttccaaaccgctcaccattggcatcgggcaatccgggatttctttcgtcttcccgcacgccaggcaaataaaatggtgatggtggtggtttgtcgagcatttgaaacggaaatgcttttcaccggacagctctgtcacttccagtatgccaagttcagcaaaaagcgataaattcctgtagatcgtatcaaaactgaggcccggatacgcatctttcatccattcgagcacgtcttttgccgtcaaatacttattgctctccgaaaacaaatcgagcattttttccctttttcctgtatgcttatagccgttttccttcaagatttcaattgcctcatccaaaagcatgttcacaccttctttttgttcaaaccggcaccgggccggaatcgtttcatataaaccgccaaaagcaaaatgacgatggaaatcaccacaattgtaccaccgggcggcaaattcagataaaatgccgtaaccagcccgcccaaaacggaaatttcgccaaaaagaacggaaaacaaaatggtctgtttaaatccccggctgatgcggatgctggccgctaccgggagcgtaatcagcgcggatacaagcataatccccacgatccgcatcgcagccgaaatcacaagcgcaatcagcaccataaacagcaaatggatcgttttcgcaggaataccggacacttttgcatattcttcatcaaaagaaagcaggaaaagttccttatacagcaaaaggatcacagccgccacaatgacggcaatccccagaatgagccaaagatcagcctggcttaccgcgcttacgctgccgaacaggtaattcatcaaatctacattataccctccggccacagaaataaagatcagcccgatgccaatcccgcccgacatgataatcggaatcgcaagttcttcataatgccggtaaaccccgcgcaaccgctcgatcagcacggatccgagcacggaaaagccggtgccaatataaagcgggttcaacccggcaagaatagaaagcttgctgcttaaaaacaggctgatcgcaatcccggacaatgtgacatggctgagcgcatccgcaatcagcgacaaacggcgtacgacaataaaactaccgatcaaaggggcaatcaggccgattaaaatgccggccaaaaatgtattttgtaaaaaatgataatgaaaaagtgcagcaatcattcggtttctccttctcacccatgttcatgcgccagcaaccggacatcgtgggcataccaggatgaacgtttttcttcatccaactgctgaaacgcgtggatgtcgccatggaaatataaatgctggttcaagcatgcaacatgcgtcactttgtcggaaacggcgccgatatcatgtgtgacaagaatcagggtaatgccccattccctgttcagctgctccagcatttcgtaaaaagaccggacatggcgctggtccacaccaactgtcggctcatccagcatcaaaatctccggcttgctgacaatggcccgcgcgataaacacacgctgctgctggccgccacttagctcgccaatattttgatgggcgtacgcctccatcccgactgagcggatcgcttccattgcttcttttctggcgccggggccaaggaaacggaacaggccggtttttttcaccaggccgctttcgaccacttctaaaacggtcgcaggataaccagtattaaatgcattggctttttgcgagacaaaaccgatccggctccagtctttaaagcggctgagcggcgtgccgaaaaggcggatttccccttcctgcggttttaacagcccgagcatgagctttagcagggttgattttccggaaccgttcgggccaatgatgccgagaaacgctccctttggtatgtttaaatcgatctgttccagcacattctgccggtcataacggaaagagaggccagaaacttctacaacatattcttccatacgcaaactcctcaatcagaatcattccgatttaaacattataccttctttccgaaagattgtaaagcgcggaggggttcacgtggaaatgccggtaattgccgccttcttatcgcttttcttcctccgcggcaatatccccttccataagcatctgaaacatttcttcccggcccgcatatacatgaagcggggagagtgatggatattgaaactgattcaaaatatggtcaattataaggtgaatatcattaccggcgcggaactttttaaatacgcgcggcagtttaacgtgaaaatcagccgcgaagatgcggaaaaaatcgcggattatgtgcggggaaaacagttggacatctttgatgacgaggcccgcagcaaagcactgaaagacattgcaaaaattacaagcccgctcaccgcaaaagaaatcaaccgggtgtttgtcttattggcaaaatagaaaaagaaccggccggaaaaagcttttcggccggttcttccttatttcactacgcgcctgacaacgccattaaagcactgtttccagtaaccgctgctcatggtgtcgatggaaacgccatctgaactattgcaatcgagaaatttgccgccgcccaggtaaatgcccacatggccgttgtacttataagtattgaaaaagaccaggtctccccgtttcatatgcgaagcactgaccgcttgcccaagccctgcaagcgtatccgtattcgcaccggagccacccaggttcacgcctgcctgtgcgtaggcccaatgaacaaatgaggagcagtcaaaaagcccgtttgcaatgtcgcttttcgttcttccgccgcccattttataggaagtgtgcccgattaaagctgaaccggcgctgatcgctttttcaaccgttccggaaccgttgtttgaagcgctgccgtcatcagaaaaggaaggtacgcgcgccacatgttttgcgcgggatccggactttgtcttttccttctgtgtatgtgccgcagtttctccatttgaatcgtctcttccggtgctcgtgccggtagaagcggaatcatcctgcttcgattcctgaggcgcggaagattttgcagcagtagcagatggtgcggtctcggtctctttgctttccagttcagcgagcgctgctttttcctgcgcgtttaaggaagcttccttgtctttcagcttcgccaattcagctgcagcagcttgtttttgctccttcagcgccgcttctaagcttttctggtccgcaagctggtatttgtttgcttctttcaactcctcaagctcagctaaatccgactgcactttctgaagcttcttttccacttcagcttttgctgtatttaatgttttgttgtctttttcctgcgcttttaaaatggcgcggtctgcttggacaaacgttgttaacgcttgcgctcggctgacaaaatcgctcaggctgctggattcaagcagcacattcagataactatccgctccgcctttttgttgaatgtcacgcgcacgccgggcaagcacgttgttgcgctcttctattcttttttgcgtttctttcattttttcatttaacgatgcgacctcgtctttcgtctctgacacttcttgcgttttttcactgattttctgattggtttggcggatcttagccgaaattttttccatatccgactgaaactgcttcgcgttttctgcgatcttcgcaatctcgttttgcttgccggaaatgctttccttaacggccgactcctcgttttgaatgctcttgacagcggtttctgcatttgctttgctaagcgggacgaaagcgctgcctgcgatcactgcagcagcggttaacgacaaaaacttcctattcaccttaacgcctccattgctatgtatcggctttttctcattatgtgtagattccgttctattaatctattgatatttctgattatagcattgatggtttgataaatagattacagttatatttcattttgcaaatggaggtttatttttaaaaaatcccggccaaacgaaaaccactgaaactgtccagatgcaaaaaacgatgagacactaagaatgtagtgtctcaccgttttgtttcagcggctttaaaacctgaccaggattcaagcgggctgctccacaattttggccagcagattttcgtcaaatttcctgtttctaagcatggcaatttcgtatttgtacggcggcttgcggttctttttgtcttcgccgacataaggggtttccaaaattttcgggatgtcagaaagcgccgggtgatgcacgatatagtcaagggcttcaaatccgatatggccaaacccgatattctcatgccggtctttgtgcgagccggcttcatttttgctgtcattgacatgcaatactttcaggcggccaatgccgatgatccggtcaaattcatccagcacttcatcaaaccggtttttcacatcatagccggcatcatgggtatggcaagtatcaaagcaaacggaaagcttgtcattgtatttgacgccgtctataatttccgccagttcctcaaacgtcctgccgcattcggatcctttgccggccatcgtttcaagcgcaatctggacggtttgctccggaacgagcacctcattcagcccttcaatgattttcttgatcgctttttccggccctgcaccaacatgggcgcccgggtgcaaaacgatctgcttcgctccgatcgcctccgtccgctcaatttccgaccgcaaaaaacggacaccgagttcaaatgtcgcaggatttgttgtgttgccgatattgatgatatacggcgcatggacgacaatctcctctatgccatgttctttcatatgggcaaggccggcttcaatgttcaagtcctcaattttcttccgccttgtattttgcggtgcgcccgtataaatcatgaatgtgttggcgccgtatgaaaccgcctcttcacttgacgcaagcagcatttttttgccgctcatcgagacatgtgaaccaattttaagcatgctgtttctccccttttatttccgtttttgcaatttcctttgccgttttttcagcatttcgatctgccgttccattttctttttgtagcccggcttcacttttttcggcctgccgattgcctttctcgccgcagtctccgtttgatccgccttttttacccgctttttgcggcggttccgatcgcccagttccacccattcgccgcggcgcacatcgcggtagagaaatgcaatccccattttctcaagctgggtgagggcaaactcatcggaaggttcgtaaatggtcgcgcatatgcccgacagatcggcgcgggccgttctgccggcgcgatggacgtaaaacgttaaatcttttggcagctcgtagtttacaacatggctgaccccttcgatatcaatcccgcgcgcggccaaatcagtggcaatgatgtaccggtattccaggtttttgatttgtttcatcgttttcgcccgttcccgcggcgagaggtctccgtggatgcgggccgttttcatcccttttgctgagagccctgctgcaatttcatccaccatcgcttttgtgtttgcaaatacaatcgccaagtacgggttaaacgcctcgaggacatcatgcaacacgtccattttctcccgcgcgcgttttgggatcaaaatatgttcaatttttttcgctgcgatttggcgcggcgctacctgctcgaatttcggattttccatgtacttttttaaaaacggctttaatttttcgggaatggttgccgaaaacacgagcatttgcagtttttcagacatcctccccgcgatttggtcgacatccacgataaagcccatatcgagcataatatccgcttcatcgacaacaaacgttttcgctgtatggacaaataacgcctgttctttcacaagatcatttaccctgcccggtgtgccaactacaatttgcggttgttttttcagtttgctgatatcccgctgcttgtccgtcccgccgataaatagtttagcggtaagacggcctgtttcttcccattttaaaatttcctggatttcatggtatatctgtgccgccagttcccgcgtcggggccgtaatcaccgcctggacttccgcaagagacgggtctgctttttgcaaaagcggcaacacataagcatgtgttttccccgttcccgtctgcgactgtccgatagcgctttccccccgcaaaacaagcggaatcatttttcgctgtatttccgtcggttcggcaaagcctttatgttcgatcgctttttcgataaatgatttaaaaccgaaatcttcccattttgttccgttcatgtttccactccttctctcatgcagcagaacgtcttgttattataatcgacatccgcgaaaaatgccaatttccgcatgcccccgtatgcaaatggaaatttttgtgccgtttacaggcagaaagaaactttttttgcatgccagacgtttccgtttggcctgcatattgtaatattgaacgaaaaagccaaacagaaagggggtcaaatggatgccgccaagaaatatgtcgccctttttcggccggcaaagtccgtccccgttcggcggaatgcagcgaaatccgtttgccgggaaccgcctgggcgggccgggcatgcccgggcaattcagagccggagggcaaatgccgggatttccgggtagagcaggcgcaactgcaggacggggcggagggcttttatccagactgttccaaaggggcggacaaagcgcagccgccaacccggcagctgccttccagcggggtgccgccgggggaggcggatcgcttttcaaatccatcgcaaatccttcttcgatcagttcgtttttaaacaatacacaaaatgtcttaaaaaccgcgcagcaggtcggcccgatgatccagcagattcagcaggtcggcccgctcgtcaaaaatctgccagcgatgtggaaactgtaccgcggcctgaaaaatgccccgaatgaggatgagcaggatgagcaggaaaatcgcgaattaagcagcaaagacaaaaaacctgcgccagcaaaagagaaaaaaagcaaccggcaagcggagcgtcccgcatctcaagccgcagaaagcaaaaatgacgaaaaacgcccggaaaaaggagtctccgtgccgaaattgtttatttaaggcgccaaaaccgtttgtacccgtgtgcagacggttttttctgtggccgggaaccattcggtatctggcgcaccaaaagtttgcacccgcgtatagacggttcgttctattaaaagctggcattagcctctgcttttccatccttccgggagcgcgccatatttcgggcacggccggctgtgcaaaaacccgttttgtattctttgccgcattccgatataatacaaatgtaatagactcatttcccagcccggatgccggtgttccggcaccctgttaggaggatcgcgatggaagtgctgaaaatttccccccggggttactgctacggcgttgttgacgcaatggtcattgcccgcaacgccgcaatggataaaactttgccgcgtcccatctatattcttggcatgatcgtccacaaccagcatgtgactgatgcctttaaagaagacgggatccttacgctcgacggcaaaaaccgcaaagaaattctcgaaaaggtggagaaaggcaccgttatttttaccgcgcacggcgtctcccccgaagtgcgcgaacttgcccggaaaaaaggcttgacggccattgatgccacatgcccggatgtaacgaaaacccatgatttaatccgtgaaaaagaaaaagaaggctatgatgtgatttatatcggtaaaaaaggccatccggaacccgagggggcagccggtgtcgcacctgcgattgtccatctcgtcgaaacggaagcagacgttaaagccctcgatatccgcaatgataaaatcattgtaacaaaccagacgacgatgagccaatgggacgtggcggatttaatggaacttatccaaaagaaatatccgcatgcagaaacgtacaatgaaatttgccatgcgacgcaaattcgccaggaagccgttgccaggcaggccggggaggctgatttgctgcttgtagtcggcgacccgcgcagcaacaattcaaaccgcctcgcccaagtatcagaagaaattgccggcacgaaagcataccggattgccgatgtcgaagaaattgagctggcgtggcttgaaggtgtacaaaaagttgccgtaacggcaggggcatcaacaccgacgccgatcgtacgtgaagtcatagcatttcttgaaaaatttgacccggaagacgaatcaacctgggaacgaaagcggaacgtaccgttaaccaaaattttgccgaaagtgaaagcgccgcaccgttcttccggccaaaaagcttgaaacctggttgaaacgcttccggccggaatggaatataagcaaaagggcggatccccaccggactccgcccttttgcctttcatcatccatgctggaaaaaatgcagcatcatgaaaatcaattggtgtgtatttttagtccatacgagatgcaacggggccccgtccaaaagaaggaaaatgagctatcgcaatctttttaggataacgggacccgggttaaaaaaggccgtctttttccctacttcgagcggcccgggcgttttttaaagaaactgaaacgggtctgtgttcacttcggatgcaataaagcggacatcgagctgatgctccctgcatgctttctgcatataagccgcgaccccttttttcatcaccttctccacgttatgtccggggtctacaacattcagcccgagcgccagtgcatcgtgggcgttatggtaataaaaatccccggtgacgaacacatcggcccccgccttttttgcctcagcaaaatatttgttgccgtctccgccgagaacagctacttttttcactttttcgtcgagatttccgacgacgcgcaatgccggaacttcgagcgcttttttaacatgttccgcaaattcccgcagtgccatttcccgttcgatttcgccgatccggccgagcccatacttccggccttcatttaagacccgataaatatcataggcaacctcttcatacgggtgcgcctcaagcatcgcagaaagcacctgtttttcaatcgacacgggataaatcgtttcaatccttgtttcatctgctgcttcgagctttcccgcttccccgaggaacgggtttgtcccttccctcggcagaaaacggccggtaccgcgggcagagaaagaacaatggctataattcccgatcgcccccgcaccggcatttccaagcgccgttcttacggcttcttcatgggataccgggacaaaaacaaccagtttcctcaatttgtcttcataaagaggcgataatacttccgtatcgcggagcccgagcgcctccgccagcaaatcgtttacacccccttctgcgatatcaaggttcgtatgggcggcatagacagcaatcccgtggcggatgcatttttcaatcagccggccctggggggtatctgtcgccatgttttttaacggccggtaaacggaaggatggtgggcgataatcagctggacatccttttcgatcgcttcgtccaccacatcttccaacacatcaagcgccaccagcacatttttcaccggcccgtttaactgcccgatttggagcccgaccggatccccgtccattgcaaactttttcggtgcgaactgctcaaatagctggatgacatcatgcccgttcgcatgcttcatgttagaacctcctctgccaaagcaatcaaatggcgatatacacgctttttttcttcaatttccgggcttgcgtctgcctgctccagatggctgagcacggattgccatttttcgatttcattacgccattttttccggaaagcttcattttggtttttgattaaaaccgggcccatcaggcgttccgcttccgtgagcaccacatggcggcccgcgtattctgccgcaataatttcgtatattttcccgtcttcctcgagaatgtcttctcctgtgatggcccatccgttttccgccagccatccgcggacaatgtgcgacccggtattcggctgcaggatgagcgtttctttgccgtttagttttgcttttccgcgatcgaggatagaggcgattaatgcgccgcccatcccggcaattgtaatgcatcccgcttcgcccggagccaagatctcaagcccgtctcctttccggacgctgatttttccggtcagccctgctttttccacttgcttttgcgccgaatggtacggcccttccgccacttccccggccaccgccgctgtgacgctaccgcccttcacgcaaaaaacgggcaaataagcgtggtcagacccgatatctgccaatacagtgccggccggaataaaagccgccaccgattcaagccttcttgaaagtttcccgctgttcatttcttcaccactttacatctgatacctctattgtagccactttttgtcataaaaaaaagggggatgccccccgtacggtgaacctgcccattattttaattttgatacccagtccgccatttcatcaatatggtcttcttcgacaagtccggctggcatgccaccgctcgtgccgttcctgagtacatctttaatcttatctttggacaatttcttaccaatgccgtggagattcggcccggccccgccttgcaaattatttccgtggcaggtcacgcaagtctttttggcaaagctctccggatcaaacttttccgaggaggcggtttcggtttgcttcggatgctccttttctttggccacttctttcgcatccccgatccctttcacggaaagaaaaaagataagggcaagcccgaataccataatcagcacatatgggattacaggatttcttttcaatacattccccccttgtttttccgcttttccagcgtatttaccgtgcccatctcctccattttaactgaaaattcttttgaaagaaagcctttccacttaaaaataacggttgaatgcgctttcatcttgtattataataaaagcagcaaaaaattcaataaagtgatacaattgcaggcgggccggaaaagggcaacaggaaaactgaaaattatacattatattactatagagaccagcaagatgacgaggccgagaaaccccgataaggtaaaatacagcagcttgtatgcctttccggcgataagccacaacccgcagttgacaagaagcagcaaatataaagtatagcggtgatttccaaacaccttttcattcaaaaacacactgagaagcagcaaaataatcgcggcgccaacaaagaaaaccgggtaaaaaatttctttattagcataatgaattcccagaaaaagtaagcatccgacaaaagctgtcaaaatcatcgtttgcaaaataaaatgtaattcagtaaaataaatgacaaatacagcgattgcaatgagggcaagaatgaaaacagaaaccgcggcttgttttttaacggatttccctgcgccgttttgtttgcgggtattggcctcatttccctccgtatagatcgcgagtagaaaatcgcagtatttttgtggaatcattttggtctctttccacattttaatttcgttgacaatgatttgttttctcttatcgtccatttttcaacacatcctgtgtaacctattcgacaagcgggcggaaaatccttttttttgcaagaaaaaagtttacttcccgaggaagtaaactaaaaacaaggcgcctgtaaaaacagatgcacaagcgccatgtctgtttctttttccggcttattcaagaaaatctttcaggcgtttgctcctgcttggatggcggagtttccgcaaagcctttgcttcaatttgccggattcgttcccttgtgacaccgaatactttgccgacttcttcaagtgtccgagtgcgcccgtcatcaagcccgaaccggaggcggagcacattttcttccctgtcggtcaatgtatcaagcacatcttccagctgttctttcagcagctcataagcggcatggtcagaaggtgatgtggcatcctggtcttcaataaagtctccaagatgcgaatcatcttcttcgccaatcggcgtttcaagtgaaaccggttcctgggcaattttaatgatttcccgaactttatccggagaaatatccatttcttcagcaatttcttccggtgttggttccctgcccaaatcctggagcagtgaccgttgcacacggatgagtttattgatcgtttccaccatatggaccggtatccggatcgtccgtgcctggtctgcaatcgcgcgcgtgatggcctggcggatccaccatgtggcataggtgctgaatttgtagccttttttgtaatcgaatttttcaaccgccttgatgaggcccatattgccttcctggatcaaatccagaaactgcatgccacggccgacataccgttttgcaatgctgacaacaaggcgcaagttggcttcagcgagccggcgttttgcttcttcatcgccctgctcgattcttttggccagttcgatttcttcgtctgcggaaagaaggtcgacccgcccgatttctttcaagtacatgcgtaccggatcattgattttcacacctgggggaacactcaaatcattcaggtcaaactcttcgtcattctctttttccagttcgagatgggaaggggcatcctcgtcgctggtgtcatctgtcacatcgattccttgttcaccgagcgattcataaaattcatccatctgatcggatgttaaatcaaaatggccgagtttttcggaaatggtatcataagtgagaaacccccgctttttcccgcgttcaacgagttgctcttttgctttttctactgtaaactcactttcttctacttctttggaacgtgctgacttttcagccatatgttcccctccttccgacaatttcaacactttcaatgatccaacagcaacttgatcatttataaaaagcagagatttcaagtcatagactttctcagtgccacaatttcacccgccaattgcagcgctttttggaaatcattctgccgttcggcatctttttgtgccctcagtttttcctgaatgcgcagcaacttctggtgttttagcacatattgcacataatcttccaattcctcatccgtcagctccccgcctaccgtcatcatttcgatttcggcagcaatccgctgcagttttgcatcgggcaaataagacaggaaagcgctcgtatcaggcggattcccttcttcgtaccagccaagcaggtaagtaaaaattgcctggtgttcatccccgtaaaagctgttttcgccaaggaaatctttcactttataggcaatttccccgtcccgcagcatatgccaaagcagccttctctctgcagtcatattggcagggagcatccgggcttcctcatgtgcaggcaccggattctctgcagggcggcttctcttccgggtcccggtttcacgggaaccgtattgcctttcctgctctttcagggcgtccaaagacaacgaaaattcttcggacagctggcgcaagtaaaggtctttctccaccggattctccagtttggcaatttcctgaatgacttcttctatatacgccagcttttctccttcattttggagatttttattcatgcggaaatattgcattttaaaagccataaaagtcaggctggcccctattacatccatgcggaacttttctccgccatgctggtttatgtagtcatcagggtccagcccatccggcatttgcgcaacccgcacttcacagccgttttcactgagcattttccccgcacggaaagcagcagtgaggccggcctggtccgaatcgtagcaaatgacaacgccgtccgtgagcctttttatcatccggacgtgttccggtgtaatcgaagtgcccattgtggcaataccgttttcaacgccagcccggtcggcggagatcacgtccgcatagccttcgaaaatgactgcctgctgttttttgcggatcggccctcttgcccggttcaggttaaaaagcagcttgcttttattaaaaagcggcgtctcagggctgtttaaatatttcgggtgttcctgtttccggaccgctcttccggcaaatgcgaccatgtttcccttttcatccatgatcggaaacataatccggtccctgaaacggtcgaaatatttgccgtccttttcattgcggatgacaagcccgctttcttccagcacggaaaggggaaaaccgcgcttttgtagcatattggcggcaaaatcccaggcaggcagcgcatatccgatcccgaacttttcgattgcttcgtctgtaaatccacgcccgcgcaggtactttagcgcaggttctccttcttttgtatgcaaaagcaaatggtggtataatttttgcagcagttcgtgcgcttccagcatctgccggcgcttcggatcgatgtttttctgctcttcgtgccgtaaaacgacgccaagctcgatatgcgctttttgtgccagtttctctgccgcttcctgaaaagagatgccttcgatatccatgagaaaagtaaatacattgccgcctgcgccgcatccaaagcagtgaaaaatctgcttatctggggatacggaaaatgacggcgtatgctcaccgtggaacgggcacaggccgaaataattgcggccctgctttttgagctgtacatattcgctcacgacctccacaatatcggaagaccggcggatctcatcaattttttcatttggaatcatccctgtcatcaaacaatcccttctgctccacctttattcacagcatttcatccgggatacggcaatgcttattcgtttgctgtttttcttttcatcctaaaatattctacattgctccgcagaatcctgcatgttttgcgcttcttcccataatttttttggccctgtcgaaatttattcaaattcagacttgacatttactcataaatagtttattccttaaaagcttactctaaacccgtatcatacatttttatcacaattttttattatagtacacttgctccattttgactataaataaatactgaaaaacagaaaaaaatatgcctcgtttttttcaaaagaaaaatttttaaaaaaacgggtggaagcaaagaccgtttcagcctgcttccaccgtttcaattggatttattttcatccggccgatgccgcaaaaaggcatgcgcttctcgaaccttgaccgcttttactttctcatttcatccataataatatttgccgtttcttcgaccgctttgttggtgacatcgatcactttgcagccaagccgctccgctacctgattaaaataatccagttcgtatttgatgcgttcaatggtcgcataacttgccgaaccatcaagcccgagtgttttcagccgttctttccggatatgatttaatgtatcaggatcaatttttaaaccgatacattttttggaaggaatacgaaaaagttcttccggcggatccacttccggcacaatcggcacattcgcaactttatagcggtgatgcgccaggtattgtgaaagcggcgttttggacgtacgggaaacaccgatgaggacaatatccgcccggacaatgccgcgcggatcccggccgtcatcatatttcaccgcaaattcgatcgcttccacctttttaaaataagcttcgtccaattttctgacgagccccggttcatagagcggcttggattcatacaattcgagcagccggtccatgagaggtcccattaaatcgacagcagcaaggccgtgttttacggcttggtcgttcatgtatttccgcatttccggcttcacaagcgtatagacgatcatgccgaaattcatggatgcaagcgaaaccacttcatcaatatggatcgtatcttccacatacgggaagcgttttaattctgcgtcctggttttcaaactggctgatggccgcctttgtgacgagctccgccgtctctccgaccgagtctgaaacaatataaatatggggttttgccaaaaatgatcacttcctttttaatcgccgtctgcaagttcaacgaacgctttcgtgatattcgttttcgttatccgcccggtcacttcaagcccgctttctgtttctttcacaacgggcaccgagtcaatttgtttttcaatcagtttttttgccacatcaatcagaagatcatcttttttacagcaggtaatattcggcattcttgtcataatgatatgcaccggcaatgccgataggtctttgtttccaaggcttgcccgcaacaaatcttttcgcgacaaaacaccgatcagatgggatgcattgtcgacgacataaagcgtgccgacatcttcaagaaaaaccgttacgatggcatcgtacacggacatattctcgttcaccacgaccggcaaagactgataatcttttacgtaaatatgttttaaattttccgtaagaagctgcgtgctcgtttttccggtataaaaatagccgacgcgcgggcgtgcatccaagtaacctgccattgttaaaatggcaagatccggccggagtgttgccctcgttaaattcagcttttcggcgatgtgctcgcctgtaatcggcccgttcgttttgacgatctcgagaatctgttcttgccttttcgttaattcgatcgtaatcaccgccttcattcacacaaccatgcaagacaatagtataacacatttacggaaatctgtccttatctgccactatgatacataaaaatgccattgatattttggaagacagctgcgtatactcagatagcgggtcatgatttttcggccgggcaaaaacagttaaagcagaaccgcgggccgtgcgatgcatcatccggccccgggcagcaaggaaagtccccctttttcttcgatagggggatgtcttatgcattgtccggcccgagccttttttcgagcgactctatctggctaagaaaccggccggctttcagttgcaggccggtatattcatcatagtacatggaaatcgccgttctcagctctttttttgtcgagtctttaacagaaatgctgccgagccggttgatgtccagaaaataaaaaagccggagcaggcggatcgcaggctgtgacaacgggagccggtacgggtcgcgcgcaaaacagcgggggcaaagaaggccgttttcccggatggaaaaagcaaagggcccttccgtgttgccgcataccgcacatttgtccatcaccgggtacataccgagtacattcagcatcttcatttcaaagatgtccctgataatttccgggtcatagccttcatcgatatattcgagcgtccggagcaaaagctcaaataaagacggattcttttttttatcttcgaccgcccggcccaaaagttccaccacataggcagcatacgccgttttgaaaatatcttcgcggatatggcgcatcggtgaaacggtctctccctgttggagggtggcaagaccgcgcgacggctgaaaaaggaaattcccatatgtaaaaacctgggaaaccgccgccagtcggctgttcggctttttggctccgcgcgccataaagcctagcttcccaaattcttttgtgtaaatatgcaggattttattggattcgccgtagtctgtatttttaatgacgatcccttcacatttttcaaacaacctctccacctcttgcccgacaggcagtacggcttatccttaagtaatggaaaaatccgcatctgccggatcttcttcacgttcataccggtcttgacgccggtccctttccagttccttaaaaagcaggtacgtatcaatattgccggtatccgcaaagactttccaggtaaattctaacatattcaccacgcctttcatgttgtaggtcatgaaatttctttaaaagccttttatagcttcaccaggggacacgcaaacattcggggtaaaaatttacaaccagaagcgggcgccaaaatcaatattcgtcttcccggaaaccgaaatcgcgcagctggctgattttattccgccaatctttctgcacttttacccataattccaaataaacttgcgacccgagcaaattttcgatatcagcccttgctcttttgccaatctctttcagcatgcttccctgcctgccgatgataatccctttttgggacggccgttcgacaacgatcgtcgccatcacgtgaatgacatccttgttctcttcccgctccattttttcaataacaaccgcaatcgaatgcggcacttcttctcttgtaagctgcagcgctttttcgcggatcagttccgaaatgataaagcgttccggatggtctgtcacctggtctgccggataatactgcggcccttccggcaaatatgccttgatggtatcgagcagccggctgacgttgtttcctccgagtgcggaaatcgggaccacttcacggaacgggtataaatctttgtactgttctatgaaggcaagcaaatcatccggatgaacgaggtcaattttgttgatgaccaaaaaaacaggcgtgcgcacgtgtttaagcagttcgataatgtactcgtccccgcggccgcgtttttcttccgcattgaccataaatagaatcaggtccacttcttttaatgtatccgtggctgattttaccatgaaatcgcccagcttatgcttcggtttatggatgccgggtgtatcgataaaaatcatctgtgcgtcatcagctgtgtaaacgccctgtatcttattccgtgttgtctgcggcttatcgctcatgatggcgattttttgcccgaccacctggttgatgaaagtggacttcccgacattcgggcgtccaatgatagaaataaagcctgatttatatgttggttgttccatgcaaatcctccgttgaataagtgcccgaaagcagctttaccattgtttccatatcttttccccttacctgtattttactacaaatagacccgaaagttaaaatgtatttttcatcacttttgaatattttaaaagttcgtgaaaatattgtcgactcgtggtgaatttacactgattttagcgtcacttagtatgccatggccgttttcaagtagtgtgattacctttattttagcgcaacggcctgtgcctttcaaattgcggcatatccatgggaagacctctctcttgatgttcatttaacggtgtacatttagataatagagtgtctccccattttttccactcatctgcccttcgagtaaaattttacacataccagatctcgtatgccgtttctgtacgacagtccggctgaagcagggcatctgcttttttacgccgaaatcgcgcaggtaaggacatttgggggagggccataaaaaagaagccgcattaaaaagccgctccctggaatacatgccataattttggaagaaatacgatgcagccgataatggccgcaagcacggcccacatcaggactgctgccgccgctgcgtctttcgcaagcttggcaagcgggtggtatttctgcccgacagtcaggtcaaccgcccgctcaattgctgtgttcatcagctccattgcgatcacgccgaaaatggaaattaaaatggcgatccattctgttttggaaagggagaagaaaaagccgagcaaacaagcgcaaaacgccgccagaagatgaaaacggaaattccgttcctgccggatggttgcaaacagtccttccacagccggccggaaaggggtgcggtatttcgggatttttttatcgtttaagtccatagcgatcgaggatctcgttttggcgcccgaacatttccgtttcatcttcttttgtcatatggtcatagccgagcaggtgaagaaatccgtgaaccgccaaaaagccgagttccctttcaaacgagtgcccgtactcttcggcctgctcccttgcccgcggcacggaaataatgatatccccgagtacgcgcggtatttctgcaccagtaatttcgatctccccttcccccatttcttcaagcgcgaacgaaatgacatcggtcggctggtctttgccgcggtaatcgcggttgatttcgcggatcccttcattatccgtaaacgttaccgacaactcggtgccgtcctccaccccttcctgacgggcagcataatcgagcaatgtccggacaagctcgagatgctccgcttcaagctcatttgtttcatccatcatatcgagtgataatgtcatgtcagccatcctttttcttatttttacgggatccttatttcggatactggatccttgaatgaaagatgccgttaagcgtctcgcaaagcgtgcgtttaacggtctccagttctttcaaagtaatgtcacattcattaaattgcccatccatgatccgcccttgcacaatattgccgactaaattttgaatatcatcgggcgtcggatggttcatggaccggacagccgcttccacgctgtccgcaatattgatgacagccgcttctttcgtctgcggctttggacctgggtaacggaacgcttcttcttttacatccgggttttgcgcttttgccttatggtaaaaatactgcagcaaagtcgtgccgtgatgttgttcggcaatatccgaaaaggctttcggcagcttatattttttcaatgtttccgacccgtctttcgcatgggcaataataatgtccctgcttgtttcaggcgaaaggcggtcatgcggattcgggacgttcagctggttttcgataaaaaatgcgggccgttttgttttcccgatatcatgataataactgccgaccctggcaaggaggccgttcgccccgatcgcttcacaagccgcttcggcaagattggcaaccatcaggctatggtgatacgtgcccggtgcttccgttaaaatctttttcaaaagcgggtggttcggattggacagctccacaaggcggatcggcgacaaaatgccgaacgctgcttcaaaaaacggctgcagccccatcacgaacacagcggacaaaatgccggaaagaaacgcaaataaaagggtatataaaaagtccgcttttacgatttggccggcattcaaaaaatagatgacacagacggcaagcacattcaatagcgctgcaaaaatcccggtttgaaacaaccgggtgcgctccggccgtttcggtaaaagcaaaatgccccctgtccctgtaataagcgcgtatacaaccatctcggcgttaaatgtatctgcaatgtcgccatgaaattcgatgctcgcacaagcggcaagcagggctgaaagcaaaaatgcggaacggtccctgagcaaaatccgagcgagcagcggcgccattgcggccggataagcgtattcgatacccggaatctcaagatgggttaaaatacccgccagcttcatcaatgccagggcgatgacaagaatcagcccggccatgacaagccggttttgcttttcttcttccgttgcgcgcatccggctcgtatagaggtacaaaacgccagatgcaaaaaaggcaaataaagccaatccgatatacggcttaaccgatccgctgctttttaacagcccgagcagctggagttcgcggtaagtttcccggtcgatcagatgcccttcctggacgataacctgtccctgcaggattttcaccggttcaacgttatccctcgcctgctgccttcttttttccgtcagctttgcatcgtacacataattgggcacgatcgcatattgaccaagctcggacgcagcattccggatacccgcttttaaccccgacctttcgatttgcgaggccacccggcttttggcttcagccgcattgttttctgtcactttttggctaagtgcctcattgacattcgtttcgacaatgtttcttgccgctttcaattcatccggggtagcggacaaaagcgcgcgaaaacttgtgtcggaaatcgaaccggtcacattgccggacacattttcagacaatatttccttcaattttgccagcttctcttcctgcagcccgctgctgttttttccgccgtgttttttatttttatattccgcgttcacttcttctgcaacgtcaaaaatcgaatccatcagcgaaacccggttttgtgccaggccgctgtcaaacgtatagactttcgcaacactggcggccgccagctgtttttcttcttttgttttttcatcatcgacgatcgtttttggagaacggatcgtattgttcgcaactgaaaataacttaatatcatacgtctgtggcctgatgttcggataaaaaatgccgaataaaataagggccagtaaaaacaggatcacgaatgtaaaccatttaaagcttaacatcatccgcaacctgcccatttgcccgggaattttcatttgcttttcgtacaccgccttttgcaatcgctcttaacggtaccatcatatcagttttctggaaaaaatgcatggcaaaacaacccgggtgccacggcccgggttatgcgttttgataagcttcgataattttcgcaacaagcgggtggcgaacgacatcactttcttccagatagacgaatgaaatgccgcggactttctccagtactctttcagccgtcaaaaggccggattccgcgccttttggcaggtcaatctgcgttctgtcccctgtaatcaccattttagagtgaaaaccgaggcgcgttagaaacattttcatttgtgcctgtgtcgtattctgcgcttcatcgagaatgacgaacgcatcatcaagcgtgcgcccgcgcatataggcaagcggggcaatttcgattgtttccctttcaatcaggcgctgtgtatgctccgcgccgagcacatcgtttaatgcatcatagagcgggcgcaaatacggatcgactttttccttcaaatcccccggcaaaaacccgaggctttcccccgcttcaacagctgggcgggttaaaataatccgttttacctcgccgctttttaaagcattcaccgccatgacaacagccaaatacgttttccccgttccggccgggccgatgccgaacacaaggtcatgatggcggattgcctggatatagtcgcgctgcccgaatgtcttgatccggatcgctttccctttcgcattccgggcaatttcttcttcgtacaggcttgccaaatattcaagatggccctttttttccatttcgacagcgtaaagcacatcgcgcccgctgatcgggatgccttttttaatcaaaccaagcagttcggacatgacggcgatcaccctttgtgccgcatcttctttgccgcttgcctggatcgtttcgccgcgggtgaggatgtggaccccgtaggcatcctcaagcattttcaaatgatggtcggaaatgccgaataaaagcactgcttcgtttgtattctccaattgaagttttgccgtactttcttctgtcattctaagtctccttgagcaattggttttgcgattgcgatattttctactacttcataataaatcatcatttttaatgtaccattgcggacatgttcttgcaaaacatattcatccgtaacggttgcttcttttggcagttttttgtgcaaatcctgccttgctaatttttttgcttctgcttcggcctcttttttggtataatttctgtcccgctcttctttctcacggaccgtttccctgataaagcggatcggcaatgtccattttaaaaacttgactttttctgcttcttccgatgtccggtactgtttaaaacgggggttccggaagccccatacgtgcagcttcatcgacccgattccaatataatatttttgggctgcattgccggtgtagacttgaaaacgagaggaaagcggaagttcaaccgccgttttataccacgtttttccgtatactttccctttggctgccacagggtatttttctttatcattcccaatgacaccggaaacaagcagctggccttttttcacatactggttaatttttacaaccggcttacctttttcaacaaacatattttccaccactgctttctgtgaagcgacaagatgctgtgggcccggatgtttcaccggttccggcatgtttttctccacaacggtaaaatgataggttgtcccgcgcagctccacgccgacccatgtcacgtccggaagattgtttgtcagcttgcgctggatggtttcaatatcatcgagaaaaaactgtgaatgccctgtttgaatacccagtttgtccaattgtttgcggatttcgtgctcggtttttggtgttgcacctttgatctccacgccccaaaccatgttggaaagcaccgtgatcacggcaagaaagagaaaaaaaccgaacaggaatccggcgtttttcagcgtccttttccataaaaaaggaacgccgcgcccccttaaaaagcggacatgcaaatcttgtccccttactgcttttctgagctggtgaatgtctgaaaggcgcaattcgaacgtgacggccatagtgccctgccgcctgacattccaaacagcgaggccggcccttgtcagctggttgataaaacgttcgatcccttttccctcaatttttacagccaccgacccctgtaaaaaagttacccaatgatttttcaaccatagccacccctatccgttcaaatacaacacttcatctattttgccttccagtaaaatttcttcgggcaagatcgttttgatgacaaaagaccggcctttgattaacagctgcccgttttttaaaagcagccggacttctttatcggaaaaagtcaaaaggccgcggtggttctcaacataaatatggatttgaccgatcatcgtgattctcggaaggtccatcatgacatcctgcggaaggtccattttttgtgacatccagttttgcaaatgctgccgccatttttttgccataaaaagaaccccctttcatctcatatttatgaaacaaaaaaggggttcatcactttatttgcagtttttttgtccgaaacgtccagggccgtttggaaaccctcgtttcctgctcaaggatacggcaaagaggcgcaaaaaacatagcgaaaagccggaaatcataatgatttccggcttatatgagaaaggtcaggataattgctgctgcacaatatttctcacaaccgtaccgtcagctctgccttttacttttggcatgacggctcccatgacttttccgaaatcagcttttgacccggcatgcacttcttcaatggtctgccggacaatttcacgcacttcgtcttcagaaagctgctccggcaaatatgcgttcacatatgccaattcgttttggactttttcaacaaggtcactgcgacctgcatttttaaattcttggagggagtctttccgttgctttacttcgcgagaaaggactgttaactcttcatcattcgtcaaaccgtcttttccgagcctgatcgcttcgttttgaacagctgccttaagcatacgaattacggagagtctttctttatctttgttcttcatcgcttgcttcatatcgctatttaaacgctcgagaagactcatcattccaccctctcttaccacttacgttttttagcagcttttctagcagcttctgatttctttttgcgtcttacgcttggtttttcgtaaaattcgcgctttctatattcctgtaaagttccggttttcgaaacagtacgtttaaagcggcgaagcgcatcatcaagcgactcgttttttcgaacgacagttttagacatttctttccctccctccgaacacaaacggttacatgtcaggttgagcaacccgtgcactttattattatataatatcctccataaccggtcaacatttgcgccttgtctttcgtgatttggcttttgcttatttgccccgcctgttcctccttttggtataatagagatcaaagatggatggaaacgattggagggagacgatgaatcaacaggagacgctacatatcattgtttcaggaagggtgcagggcgtcggcttccgctaccacacccaatttttggcaaaacaatacaatatatgcgggtgggtccgcaacaaagacgatggcactgtcgaagtgatggcgcaaggcgagaaaaaagagatggaacaatttatccgcgggctgaaaaaagggccgtcgcgctttgcaaaagtaaccggaatggatattgactatttacagcaacaagaacagtaccgtgattttcgtgtgttgtattaaatgaattcccaaataaaaaggcatgttccttctcccctttccatatgatcatacggggggaaggacatgctttatttactttcatttcttttgttaacggtgacgtttttattcggcattcaccggctgcggaccgggctgtttgccttatccggcggccatgccggaaacatgctgaaaaaactggcaggccggccgctgtccgcgatgctgttcgggatggttttgacggcgcttttacaaagcagctccgccgtgatggtcatcactgtcgggctcgtttctgccggaatgctgacgttttcgcaatcgatcggaatcattttgggcacgaatattggcacgactttcacacttgaattgctgacatttgacttctcctctttgagcctgccttttttgggggcaggggcagttttctattttttcggaaaaggccgcgtcaaaagcgccgggatgattctgttcggcctctcgcttgtgttcggggcgatgcgcggatttgagcagcttgccgtgccggtatcaaaaaccgcttttgtccagcatttgtttaccgttttaaatacccacctcttgtccgctttcttactcggaatcttgctttctgcagcgatccagtctagcaccgtgacgatcgggatggcgatgggttttcttgcagccggggtattcccgcttgaaaccgggattagcatcatgctcggggccaatattgggacatgtatcaccggtcttctggcaagcatcggggccggagaggaagcaaggctgacggcatttacccatgtctggctgaatgccggaggggcgcttgtgtttttgcctttcctccatgtgctcgcggacacctgccggatgctgtcggctaatccggaacagcagcttgcccatgcaagcctattgtttaatcttctatcctcactggctgttttgcccttttccgaaagatttggccggtttatcatcgcttttcatggaaaaaaataaacaaccgggcccaaagcccggttgtttttgccatatgctttaaaggatgggcattttatccgaaagctgccccggcctcttaaacgccattctgtttgtggggggctgcctttatatcgggcacgccttttcgggcaaacaggcccatcttgtttttcgttacatggcttcgtttacggccggcatgacatcgtccatcactctgacgaactgtgcttcattataaggatacccggcttttgtaattttcactttgacgagttttccaaccatatccggggtggccgggaaaacgactttcaggtaattatctgtatagccttcgtacagcccgctttccggatcttctttgaacggctcttccggaatgacttcaagcacctcgttttcaaattgggatgcatattcttttgccagctggtcgcttaatgcaatcatgcgatggacacgttcatttttgatttcttcatcaatctggtccttcattctggcagcaggcgtgcctgtcctaggcgagtacgggaaaacatggagttccgcaaaccggtgttcttttatgaaattgtatgtttccataaactcttcttccgtttcacccgggaagccgacgatgacatcagaagtcagtgcaagatccggcaatgcttctttcaatttggtaatccgttccgcgaactggtccatcgtatattttcggcgcattcttttcagcaccgtgtcagaaccggactggatcggaacatgcatatggcggacaacgactttcgaatgtttaatcacgtcaatcacttcatccgtcagctggctggcttcaatggatgaaatgcggacgcgtttcagcccctgcactttttcctccaggtcctttagcagcattgcaagattgtaatcttttaagtcctggccgtagccgcccgtatgaatgccggttaaaaccagttctttatagcctgcattgacaagcttttgggcttgcgcgatgaccttttcgggatctcttgaccgcatcaggccgcgtgcccacgggatgatgcaaaatgtgcagaaattgttgcagccttcctggattttcaaggaagcccggtgccggtcggtaaaatacggcacttccatttcttcatacacacggtttttcataatatttttcacagcattgaccggtttgcgctctttcaggtactgttcaatatacccaagcattttggtacggtcctgtgtgccgacaacgacatcgacaccgggaatttcgaggatctcgcccggcgaggtttgcgcataacagccggtcacgcaaacgacggcgtccgggttttgtcggactgcccggcggatgatctgacggctctttttgtctcctgtattggtgaccgtacaggtattgatcacgtagacatcggcattcgtttcaaagtcggttctttcatagcccgcttttttaaacagctgccacatggcttccgtctcataatggttcactttgcatcctaatgtatggaatgctacggttgacatcctcttcacctcattaattcaaaatggtaacttatggcagaaagtacatataaaggcgccgtctccgcccgcaaaatgcgcggacctaagccgcaggatacaaatccggctgcttcaagctttttgatttcatcaagggacaggcccccttccggcccgaaaacggccagtacattgccgccttccgacatgtttgacaacatttccgcaaaccggtgctgttccccttcttttgcattttcttcaaaagcaaccagcttatattgatatgtatggctttcttcgatcagctgctggaaagaaacaggggggctgactttaggcaagtggctgcggtgcgactgttctgcggcttcccgggcaatcttttgccagcgttcgcgtttttttgcttctttctttgtgtcccattttacaacggatctttctgcaaggaaaggcaaaaattgaaaggcgccgagctctgttcccttttggatgatccattccagtttatccgctttcgggagtccgcatgataccgtcacatggaccggaagctcttttacagcggtttcccatccggtaatccgggccacaacggcatcacctgtaatctccccgatttcacaaatgcacaccttttcatctgaaaatacaccatagaagcggcttccgacggacattctcatgacgcgcgcgatatgatggtaattttcgccactcaggcggatttcctgctcaccgcgatacggccgatccaaaaaataacgctgcatggccaatcacccgcgctttgcgatgagcgcaacccagtcttccatgaccatcgtttcttcaatgatgaagccggcagaagtgagtgcgtccacgacaaggtcctttttttgccggataattccggaagcaataaaatggccgcccggtttgacatgtccgaatgcgtcttcagcaaaacgggcgatcacttcagcaagaatattggccaccatcacatcggcttgttcgtttacgcccttcaacagatcattttgtttgacggttacccggttttggactttattgagtttcacattgagcgtagccgcccgaaccgccacctcgtccagatcaagtgcaagcacccgctctgctccaagcatggcgctggcaatgcttaacacgccggaaccggtgccgacatccatcaccgagtcgcccggttttaccgttcgttccaatgcctgaatgcacatgaccgtggtcggatgggtgccggtgccgaacgccatgccggggtccagttcaatgatcagctcatcgcttgataccggctcataattttcccacgtcggcacaatcgtaaatttttcggatattttcacgggattgtagtattttttccatgccgttgcccattcttcttcatgcacttcgctgatcgtcaccttgttcgggccgatatcaatatcaaaagtggtcagattggtaatcgcctgtttaatttcctcgacagtttcacctaaaaagctgttcacaggcagataggctttaatgatgaccccttcttccggaaaatcgtccggatccagttcataaatttcaccgtactggtcgtcgtgctctttcagcagctcatccgagtcctcgatcacaatcccgccggcgcccgcttcatataaaatattcgaaatcggctccaccgcttcattcgtggtgtgaatcataatttccgaccatttcatgaacgcctcactccattcctgtttagtcccctttaaatgcccgtttcattttgtcaaaaaaattgctgctttgttcatccgggacctctccgctcacttcggcgaattcacgcaatagttgtttttgccgttcggtgagcttcgtcggggttacaattctcgtgatgacatgctggtcgccggtgccgtgcccatggacattcggcacgcctttcccgcgcagcctgaatttcgtgccggattgtgtgccggccggaatttttaatttaactttcccgtgcaacgtcggcacttcgatttcgtcgcctaaagcagcctgggtaaaagcaatcgggatttcgcagtagatgtcatcgccgtcccgttcgaacagttcatgcggccggacatggaaaataatgtacaggtcaccggccggtccgccgtttatacccggttcgccctggcctgcaacgcggagctgctgcccgtcgtcgatgccggccggaattttgacatgaattttgcggcgctttttcacttttccggtaccaccgcaagttttgcatttgtctgtaatgatcttgcctgtaccgccgcagtaatggcataccctgcggttcacaatccggccgaacggtgttgattgctcggtattgagctggccggttccgtggcagtgcgggcattctttcggatgcgttcccggttttgccccggttccgtggcaggtgtcacaagtttcctcgcgcggaatccggatgtccgtctctttcccgaaaaccgcttcctcaaattcaagcgtcatcgtatattgcaaatcagccccctgccttggcgcattcgggtcatttcttctgccgccgccaaagaaagtgctgaaaatatcttcaaaaccaaaactgtcaaaatccgagctgctgaatccgccaaaaccgtttccgcccccgaagccctggttcggccctgcatgcccgaactggtcatattgagcgcgtttctggtcatcgctcaacacttcgtacgcttcctggatttccttgaatttttctgcagcatcaggcgctttgttaatatccgggtggtattttttggaaagcttgcggtacgctttttttatctcgtctttcgatgcatctttcgcgacgcccaacacttcatagtaatcccgtttactcatttcttctcactcccgaaacgttcacataaaggtaattgtagcatttgcataagaaaaaagtcaaagccgagaatagaccagactttgacttttttcctgactcattgaaaaatggccatattgttttatcgttattttttattatcatcgacttcttcaaaatcagcgtcgacaacattgtcatctttttttccgtctcccccggcatccgtgttttgctgctgttgtgccgcctgctgatacagtttgacggacaagtcttggacgatttcctgcagcgcatcttttttctgcctgatttcattgagatcgttcttctcaatggccgcttttaattcgtcttttgctttttcggctttggaaatttcagatgcgtccacttttccttccagttcttttaatgttttttcagcagtgaatacaagctggtcggcttcattgcggagttccgcttcttctttgcgcttcttgtctttttctgcgttcgcttccgcttcttttaccatccgttcgatttcttcatcggacaaagtggtggacgatttgatcgtaatcttttgttgtttgccggtgccaaggtcttttgcgctgacattgacaatcccgtttttatcaatatcaaacgtaacttcgatttgcggaatgccgcgcggtgccggcggaatatcggtcaattggaaacggccgagcgttttgttgtcggcagccatcgggcgttcgccctgcaggacatgaatgtcaacggctgtctggttatccgctgcagttgaaaagatttgcgattttgaagtcgggatcgttgtgttgcgctcaatcagtttcgtgaacacgccgcccattgtttcaattccgagcgacagcggcgtaacgtcgagaagcacgacgtctttcacatccccggtcaatacgccgccctggattgcggcacccatcgccacgacttcatccgggttgacacctttatgcggttctttcccgatttctttgcggatcgcttcctgaacggccggaatccgggtcgagccaccgactaagatgactttatcgatgtcattcgccgtgagccctgcatcctgcaacgcctggcgtgtcgggcccattgtccgttcaacaaggtctgccgtcagttcgtcgaatttcgcacgggttaacgtcatttccaggtggagcgggcctgattcccctgctgtaataaacggcagggagatttgggtggaagtgacccctgacaaatcttttttcgctttttcagccgcatcttttaaacgctggagcgccattttgtctttcgacaggtcgatgccgtgttctttcttaaattcactgacaaggtaatcgatgatcgcctggtcgaagtcgtcgccgccgagatggttgtcaccggctgtcgcgtgcacttcaaagacgccgtcgccgagttcaaggatggaaacatcaaatgtaccaccgccaaggtcaaatacaaggatggtctggtcttcatccgttttatcaaggccgtatgccagcgctgcggcagtcggttcgttgataatccgttcgacttcaagcccggcaattttcccggcgtctttcgttgcttggcgctgggcatcattgaaataagcagggaccgtaatgaccgctttttcgactttttcgcccagataatcttccgcatacgatttcaagtattgcagaatcatggcggaaatttcctgtggcgtatattcttttccttccgccgtgactttgtgtgtcgtgcccatatggcgtttgatcgagataatcgtattcggatttgtgatcgcctggcgtttggcgacttcccctacctggcgttccccgtttttaaaagcgacaacagacggtgttgtcctgcctccttccgggttcggaatgactttcggttcgccgccttccaaaactgcgacacatgagttcgtcgtacctaagtcaatgccgataattttgctcatgataatgcctcccttaaaaattatgtaaagcgcgttactcgttcactttcaccatggacgggcggatcaccctgtcttttaaaatgtaccctttttggaattcctcgatcacaacattggacgcagtgccttcttcctgcccctgcatgatcgcctggtgatagtgcgggtcgaattctttcccgagtgcttcaatcggttctgcgccttcttttttcagcgcctccaaaatgctgcggtagaccatttccatcccgtccagcaactgggccgtatgttcatttttttcagccatggacagtgcgcgttcaaaattgtcaagcgccggcagcaggttcacaatcagatcctgtgccctgtatttctcggctgcttcgcggtccagatttacgcggcgcctgtaattgtcaaaatctgcgcgcaggcggagataacggttttcagcctgatcgagctcattccgcaatttctcaatctcctctttagctttattcagttcttcagcggcattttcggtttcaggcttctccgccttttccgctccattaccttcgccctctggcggcgcctgctgattttccgtatctttttcttccgcaaaaacggattcaatttgtccttctttcacttcatccgaagcccgtttttgttcgtctttcacttcttctgaagcacgtttgttttgttcgtctgccatgagcgttcaccccctttaaaatgagacgggcataaaaaagtccagtaagaaaggacttaaagcatgtgcttttgcgctttaagcctccctacccaatatgcccgtattgcctatccgtcatacagtttcgtcaaggcgttggtcatatcattactcaagaaatccactatgctgatgacgcgtgaatattccatgcgcgtagggcccaaaattgcaattttgccgaccggctggttaccgatcgaataggtggctgtaatcatgctgcaatctgccatctcggaaatctggttttctttcccgatttttacgtgaatgccgctcggcacgcgtttgaccaggtcataaaaactgtcttcccgttctatcatatcaagaaggggacggactttctcaaggtcatggaactccggctggttcaaaatattggctttcccgccgacaaaaattttatcatgccggttttcgttgaacatgctgattacggtcttcaggatcgattcatagttttcagtatggctgcgcaaaatgtcagcgacttctttatatattttatcccttaaatccggaatcggcacattggccagccgctcgttaaaaatattgaccattttttcaagttcgcccgggcggaatccttccggcagcgaaatcgtcttgttctccacgcggccggtatcggtaatcataatggcaaccgccgttttttcattcagcgggacgatctgcatatttttcagtttcgtatctttgacttccgggccaagcagaatcgccgtgtagttcgtcatttcggaaaggatttgggcagactttttcacaagctcttccatttcgtctattttttcggcaaaaatcgaatgaagctgcgatatgtctgccggtcccagtttttgtggcgacagaagatgatcgacgtaataacggtaccctttttcagaaggtaccctgccggatgacgtatgtgttttttcaataaacccaagttcctcaagatctgccatttcattccggatcgtagcggaactgaaggaaatgccgtttttcttggaaagcgtcctggaacctaccggctgggcggaacgaataaagtcatcaatgatcacttgcaaaatcaacagctgacgatcagttaacaacttccatcacccctgttagcactccgtataaacgagtgctaatttatataaataaattaacaaaatcccctgttgttgtcaatatatttacatcaagcgtcaactgaggagaaaagcttcaaagacttcattgccgagaaaacgcccttcccttgtcagccggagagaaccgcccttttcttcaagaagcccgcgttctgtcatttctttgatcgcgcctgcaaaaacttctttcatatccactccaaatttttcacggaaatggcggaaacggacgccttcgttttttctgagcccgagaaacatttcttcttccattttttctttttttgtctctgtatgtgtttccataacagggaggcacccgtcccggagcatgccgatatattttttcaatgcgccgtaattggacaggcggacacctttttcatacccatgggcgccggcgccgaaaccgaaatattcttcattattccaatagacgagattgtggcggctttcatagccgggtgtggcaaaattgctgatctcatactgctttaggccgtgcttttccatctcgtccattaacatgctgtacatatccgcttccgcatcttgtgacggcaagcggagttttcctttccgcagcagattgtaaaaaatcgtcttcggctcaatgatcagcgaataacttgaataatgcggcagccccatcgacaaggcttcgtcaagcgtttcgcggaaatcttcaagcgtctgcccaggaagcgcgaacatcaaatccatgctgatattggaaaaaccgatctttctcgcatggctgatcgtccggtagacatcttcccggcggtgggtccgtccgattttctcaagcaaccggtcattgaacgactggacgccgaaactcagccggttgacaccgtagtcatgcaggaggcgcagcttctcttcagacgtttccccgggattggcttcaaatgtaaactccccgtccccgtcataaggcaggatcgtgcggattgcggcaagcagtttttcaagctgcctctcattcagtgcggtcggcgtgccacccccgacaaagaccgtgctcatcttttcacaaggggcttcagccattttgatccgcatttcttccagcagcatctcaatgtattcatccaccggctggccttttaacaaaaatttattgaaatcgcagtaatagcaaatatgttcacaaaatggaacatgaatatatgcggctttcattgcatcacaaccttatttgttttcatcacgggcatgtcccggaaaaaggagcgcgcggacagccgccaatccgctccctgcccgctccggttattttttcggggtctcgtccattttcagcacagccataaacgcttcctgcgggatttcaacagaaccgacctgcttcatccttttcttaccttctttttgcttttcaagcagtttccgtttccgggaaatgtccccgccgtaacattttgaaagcacgtttttgcgcaatgctttaatattggaacgcgcaataattttctggccgactgccgcctgtactggcacttcaaactgctgacgcgggatgagttcttttaatctttcgacaatcgtcttgccgcgctcgtacgcaaagtcgcggtggacgatgaaactaagggcgtccactttttccccattcagtaaaatatccatttttacgagattggactgtttgtagccgatcaattcgtaatcaaaggaagcatacccttttgtactcgatttcagctggtcaaaaaagtcgtatacaatctcagagagcgggatttcataaatgacattgacacggatatcatcgaggtactgcatatcgataaaattgccgcgttttgcctgggcaatttccatcactgcgccgacataatcgttcggaaccataatggacgcgcgcacgtacggctcttcgatatattcgattttctgcggttccggcaaattcgccggattatcaactgtcacttcactgccgtccgtcagtttagttttataaatgacgcttggcgcggtcgtaatcagttcaatgttgaattcgcgttcaagccgttcttggatgatttccatatgcaggagcccgagaaaaccgcaacggaaaccaaaaccgagcgcctgcgatgtttccggctcatattgcagcgacgaatcatttaactccagcttttcaagggcatcccgcaaatcattgaatttcgcgctgtctaccgggtacaggccgcagtaaaccatcggattcatccgccggtaaccgggaagcgcctcttttgcaggattttcagcgcttgtaatcgtatcgccgacgcgcgtgtcttttacatttttaatcgatgccgttaaaaatccgacatcgccgacagttaattcgtctatgtacaacggtttcggggtgcttacgccaagcgctgtcacttcaaattccttgccggttgacatcagtttaatcttatccccgactttgacagagccttccattacacggatataggcaatcacgccgcggtacgaatcatacagcgagtcaaaaataagcgccttcagcggggcatccggatccccctcaggcgccggtactttttcgacaacctgttcaagaatatcttcaatcccgatcccggctttagcggaagcaagaacggcttccgatgcatcaaggccgatcacatcctctatttcctgctggacgcgttccggatcggcggaaggcaggtcaattttattgatgaccgggataatttcaagattgttatccaatgcaagataaacatttgcaagcgtttgcgcctcgaccccttgcgcggcatcgacaacgagcaccgctccttcacaggcggcaaggctgcgtgacacttcgtatgtaaagtctacatgtcccggggtatcaatcaaatggaaaatgtattcttccccgtcatttgctttatagttcagccggacggcatttaatttgatcgtaattccgcgttcccgttccagttccatcgaatcgaggagctggtccttcatttcgcgctcgctcagcgcatgggtcttttccagaatgcggtcggccaaagtcgatttgccatggtcgatatgggcaataatggaaaagttgcggatcctcctctgcctgtctaatttttcttcacggttcatcatttaccttcactcctgtattcggcacatgtacactatttctgattatatcagcaggaaagcgcgacttcaacgaaaaatgatcagccgcgcctcgccaaaaaaagaaccgcctgttcagacggctaacggtttcctgattgtccgctcccggcgccgtttacactgtccgcctgccagtaatacccagcgaacacatcggcaaaaacatccatcgtccggtacatttcttcaaaagtattatccacgccgccgacttcaatgagaaaagcatttcccgataaatcctggttgaattttccgttggttgacgcccctttcttcaaaatgacaccccttgacaggtttttatacttctttttgatcaagttatgcaaatcctcagccagctttgcattcttttcccagttcgggttttccccgccgatcacaaaagcaatttttgcatacgattttccattgatggtaacggtcgtatctttttttcttctcgaatcgcggtggatgtcaataaaatattgaaggtcgcggtcgtttttcatcgccgattcgacgacggtgcgcgatccttggtaagactggtaatactgcatatggtttttctcaagtagcttcaacacatcagtcgtattcgcctctgcgccaattcccttgtcctcgagatcctgcgcgagcctcgccccgacttttgttacgttgatcttcgaatgctgggcaaggtcgggattcgtgacgccttttaaatacggcagataggattcatgtgtatgggtaaaataaatcaacacccgtttcttgccgcccgttgtccgcccgggccgctgttttgcatcgtccgatccgccattttcctcgattttttccgtattttgtgtggccggatctttcgattgcaaggcgctgtcaggcgggacggattcaatcggcatattcgtatagtcagcgccgtctccggcaacaaggattttgctgtcaaagatttcaaatcccggcagttcacgcccgagaaagctgcgcgggtcttcaaagcggatgttggtgagcatttcaaacacgagatttccgaccggccgctcgtccgtatccggaaaatggtgtacaagcagctggctgtccgacagcaggtacttgtacaatgttttgcttgaaagatgctttgcggcttcattgacagccgaagaggaaacccggtatcccggcttcaacgacgtcaatgtgccaattaagatgacaacaagcacgagggacaggatgattatagagattaggcgtatcacactggtcagattcaatataaaaaaatggctggaatgcctgccgcttttcatcgtcccaccctttccaatcgattctattacattctatgaatctcatggaagaatagaacaccgaaaagcgggggcgccctcgggctatggcggagcgcctgcaacttacctcgtcttaaaaccggtattttcctggttcacatgggggtggagcgccgcatttagcccgctcgccagaagatttgccatatcttccataaaaatgtccacttcttttggtgtcaccattaagttatggccgagcggcgcgagcacttcgtgaatcagtttccgcttttcctgttcatccagattgccgacaattcccataaacattttccgtgcttcacttcccggcagatcttcttccgttagcctccgcttttccccgaacgaaagccctgccggtgcaagcgcccgtgaaggccggcctgattctttcatttctttgccaaaatgttttaaaagaaaatcgatcgcgtcgctcgtaatcgtcacggcgtccaccactgtcggaacgccgatcgcaattaccggcacaccgagcgtttctttcgacaattctttccgcttgttgccgacaccggatcccggttgaatgcctgtatccgagatctggatcgtggcattcaccctttccagcgaacgggatgcgagtgcatcgacgacaataataaaatccggtttcgatttttcactgacgccgaatataatatcgctcgtttcgattccggtcagccccataacccccggggcaagcgcactcaccggcctgtagcgcgattcaacattttccggctcgattttaaacagatggcgggtgacgagcactttttcgcaaacaagcgggccgagcgcatcaggcgtcacattccagttgccgagcccgacaacaaggcagctcgcctccggaccaatatttaaatgtttcaaatattgattaaactcaagtgcaaacaattcttccaccttttgctggatgtccatatccccgctgcggatgccctgcatttcaatcgtcaaataattcccggccttttttccgatgactttttccccttttttggaaatttgaaccgtcgtcacctttatatcgtttacggtccgttcttccaccgttacgccttccagttcttcgctttcccggttcttcactttctcttccactgcaagatcacgcgcttcaatcgctaaatctgtgcggacggaataaacactgagatccatttgttcttcttcctccttttggccgtttcctttatccttgtttttccccattccagccagaccattcgttttgtgcaaattccggctgtatgtattgcaatcttgtcttccatttgttacaatatcatttgttctaaagtgaaagtggacgagccaaactaagtttgctcgtaggaggtgaaacgggtgccaaacattaaatctgcgattaaacgcgtaaaagtgaacgaaaaaaactatgctcaaaatacagcggcaaaatccgccatgcgcacggcagtgaaaaagtttgaagcggcggttgaaaacaacgacgaaaacgcaaaagcacttttagtcgatgcggtgaaacgccttgataaagctgcatctaaaggccttatccataaaaatgcggcaagccgccaaaaatcacgcctgatgaaaaaattatccgaacaggcgtaacgcaccaaaataaaaaagacgcgcaatccgcgtcttttttattttgccttcatttcatgcagttgaaacaaaaacatttcaatgatcatttcttttttcagcccgcccgatttcatctggtagtcgctatcggcaagcagcgccatgatccggttcagttcatccgcggaaaaaagccccgcctgccccgccgccagttttactctgtatggatgcacttttaaataagacgcgatttgctgctggccatagccgcgccttgccaactctttcgtctggtagatgagccggaactggccggcaaggagcgccaatattttaatcggctcttcattgagctttaaaaggtcataatagatccggagcgcctcatcaatgcggcggtgaaccactttttcgacaagttcaaatacattttgctcaagcgaccgtgccgtcagcaattccaccattccatctgtaatttcattaccgcttccggcatacagggccagcttgtttatttcatgatcgagcgcaatcatattggttccggcaagcgaaatcaagtgttccgcagccttcctgtcaatccggcagccttcttcagcggcgcgggaaacaagccacccttcaagctccctttcatttaatttttttgcctggaaagttgcggcctgctttttgatcaatttcaccagttttttccgttcatccagtttttcataaggcgcaaccagcacaaaaaccgtgtaaggggcgggagatttcacgtatgcttccagcttgtccagctggtgttccactttctgtttttgcttttcagcagtcaaaaaaaacggatggtgcgcaatcacgagccgcctctcccccataaaagggaatgtctccgcatcttcgaccgctgtctcgaccggcacttcctccaggtcatacgaagcataattaaaatctgcctcttccggagtgagcgcatgatccagcaacttttgtttcgttttttgaatgaaataatcttctgcgccgtacaataaataaagcggggaaaattgcccgcgttcaatctttttccataattcatccattctgttccgctcccaaacctttcttactccctatgttaagagaacgggcgcatggttgcaagtagaaaacaaatggaaaaggggatccgtaaaatcccctttatctatataaacgttaacggaacagtcccgggaagcttttccgttaacggtggacccgtacccttattgtcacacgcagccggatatctatgaatgacaactccatccaaaacggtggaaatcgttctgaaattattatataatcaaaaaacagggagggatttggatgaatgaattcgagcaggatgtccagtcaaaaacgaacgatgttgccgatgccggagcaggttttctgatctcttttttgttttttgcgctgatatttatcattgccaccgcagcagacatcattggcagatagccccgctccgggcagtgccgaagccattccggacggttccttaattaatgtatattatgggaggacggtagaaaaggttcccttttctttgaaaaagcggtattgcaccgccccgttctcatccgtccggaatatgaataccccgttttcgctgagccgtttgaccacttccggagatggatgcccgaaacggttatgctttccgacagaaatgacggcgatccgcggatgatacttttggatgagcgtttcgcttgtcgaagttttgctgccgtgatgcccggcttttagtacgtcaatgtggatatccggataagccgccacgagtttttcttctccttcctgctcaaggtctccggtaaacagccacgtctttccccctgttttcgcataaaggacaagcgagtcattattcccctcatacgtttcgtcaaacggcgaaagatattgaaatacgcccgatttgttttgccatccgttcccacttttcatttcatataccgggatttttttctgtcgggcacaagcgagcaccttctgcatcagcggtttttcccatgaatggggcgagatatcgatttctttgacgcggagagacgtgatcaccgccgttgcgccgccaatatggtcctcgtcgctgtgcgttaaaatcagcttatcaatcgttgtaatcccctggctttttagaaatggcaccacaatatctttaccggtttcaaacggatgctccctttttttccatgccggttccggaaactggacggtccctcctgtgtcaatcaaatacgtcccccttgaaagcggcagccggattaaaatactatccccctgcccgacgtcaataaaggtgattttaccgaaaagcggatatctgtttgccgcaaggaggagcaaaagcacagaaaaaagtggcaggacagcccggatcgttttcttgccgttttccatcgccaccaaaccataaaatcccgcacctgtcatcaggatcaatccccagtatggcggcctcccggtaacgagcgtggaccagcggccgtcgaacgcttcccccgttttttccgacagcgttacaagcccgtcaaaacacgtggcaaagatggaaaacagcggcggcgcccattctgaaacaaaggcaagcgcagcaagcgggagcaaaacatacgtataaagcggcacataaaaaagattggcaacaagccccgcaatagaaaacgcgtaaaatgaataagaaaggatggggagggccgcaagctgggaaatgaacgagattgcgagccctttttgcaacgggccccggaaccgctctaaaagaggccctgaaagaagcagtgcggcgcaaacggcaaaagagagctggaatccgatattatacacgatatttgcattttttaacccatacaaaatgaaacagatggacaaagcatcgagcggcccgattggcagttttttttgcccagccagcacaagcagcatcgtcatcgccgccgaccggacaactggcgggttcatgccgcataataccgcataaaccggcatcacccccagtaaacaaacggcggcacgttcccttgtcatcccgagccggatgaacaaatagtagcaaaacccggcaacgagctgcacgtgaagcccggaaatggcaagcagatggacgacgccaagccgctggtacagctggtaaacatcgtcatcaaagtctgtttgctcgccaaataaaagcgcttctgcatacggtacggatttttccggaaatgttttttgaatttgaagcaggaagtggtggcggatttttttcaagaaaccgagcagatgctggggcgggctgttgcacgcggaaagccggtccgcttttaaaatccagcggatatgctgatgagccaaataggtgcggtagttaaatgtagacgggttgcggtttggctcaggggcttccagttccccttgagccatgcaaaccgttccgggggataaggtttgtttcaaagattccagttctgcttcgttcccagcgtaatacgttaacataaacgtttctttcccggtttccgcctttcccttgatcgcgttcccgtcgatacgcggataatcgctgaagcggacgggcatccgggcactgccggcatgaaactttgtatcatacgcaactgtctgaaaggtaccgctcaaaaaccccaacccgtaaaaaatggcggacaacaggagcaaaggccggtttcgggccaggaaaatccggatccaaaccaaatgggccgaaagaaccagaagcagcggcgcgtgaaggccaatcaggatgccgcttaacgtggcgagcgcggcgaacagccagttgcctttcacaccatcaccgtgttacgctttcggaacggatcccgtttccatttcttgataagtgcctgcaaataatgccgccgccatttgctgcaattcctccagttctgccgcttccgccccgtggtcctttgcaatcatgaataatttctccaccagtttggctttttctttcgcccggatatcgagcgtttccggatggaacgggacatgttcgacatgcacccccgctttttcaaaaagctcctttgcatacggatgtacccggtaatcttgggcatagtacacgttttgaatccctgcctgaataattgctttcgtacagtgcaggcacgggtaatgagtcacataaagatccgcgccgtttgttgccaccccgaactttgcacattgcaaaatcgcattcatctccgcgtggatggtccgcacgcaatgtccatcaatcacgtagcagcctttgtcaatgcagtgttcgtcccccgcgatcgatccgttgtagccgcctgcgataattcttttatccctgacgatcgtcgccccaaccgcaagccttgaacaagtgctccgccaggataataaatggctttgcgccaaaaaatactggttccaggaaatccggtccatttttctcttcctttctgctcatgtgattactgtaaagtgatggaattttcgattttcgcaaaagtctggtccccaatccccgacacatttttcaaatcttccggtttttgaaaagggccgtttttctcccggtattcgataatggccgcagcttttgacggcccgatgcccggaagcgtttcaagctgggtctggtcggccgtattgatattgacctgtgcggccgcttcaccgcttgccgccgtcccggaagaagaggaagcgggcgcagaaattccggcagccgccgtggcagtttgggcagaagccgctttttcgccttttttcggcacctcaatcaccatttcatcttttactttctgcgcgagattgacctgattccggtcggcgttttcattaaagccccctgcttcctgaatgaggtcatagacccggtcatccgcttctgctttgtagatgccgggatgcttcaccgcgccttttacatccacgtaaacttcggcagcgttctgcgtttgggccggggcttgcgtttgtgcggtattttgggtcccgttttgattttgcacatctgtcccgccctccgcaggctgtccggactgcacggccgtttcgggttgctggtaagccccggaagcagtgtccatacctccattttggctaaaatagtaaaagattgcaatcgtaatggctgccacagccgcagctgcatgccagcggtatttgagaaacaacgttttcaaagacgttcacctctttttttccattttgtttttggatacataatcgcctgaatttgtacatatattgtaccgggcgctgaaagatcggcggcttgaggaggggaagccagcatgaacattggcgtgatcggaacgggaaatatgggtagcatgttaattgaagctttgatagaaacaaaagccgttacgcctgcacaattccggatcacaaatcgcacacctgaaaaagccgcaaaacttgcaaacaagtatcccgggatgcaggttaaaaatatagaaaatactattttggagagcgacttaattttgctgtgtgtaaaaccgcttgagatgcacggcattctagagaaggctgggggcgccttccggaatgatcagtgccttgtcagcattacaagcccggttacagtcgggcagctcgccacaatggttccctgctcgtgcgcaagagccatcccgagcattacaaacagggcagctgccggtgcggtgttgctgacatttggcagccagtgcacaagcgagtggcagggaaaattaaaaacattgttctccaaaatatccaccccggttgaagttgaccagcaaatcacgagagtggcatcggatttggtcagctgcggtcctgcttttttcagttttttggcacaaaaaatgatagaaggagccgtcaacaaaacaaagattgacagcgacaccgcttgcatattaacggctgagatgttgatcggcctgggggaactgctgaagcagcaaatttatacgctacctgccctgcaggaaaaagtgacggtaaaaggcggtatcaccggcgaaggattaaaggtgcttgaaaaagggacggatggcttattcgaaaaactgtttgaagcgacgcatgagaaatttaaggaggatacggacgcggtggccgggcaattcggcacaccatgatatttcgacatctttctgtttattcctgcttcttttttaaatttttttcaaaaaaagcattctgcgtaggcagaatgcttttatcgtttgatgcacgtaaaaaatatcctttcactttttgggccgggcgcttcttctgtaaaatcagcagcgggcggcataacatggaagcccgattccgtaagccagttttcataatcagcaaccggaaacgtccgctgtttatgtaattcatcaaaacgttcatacaagccggatttctcatcatatacgaaaaaactgagatcatgttcaacggcatgcgggcgctcacccggaaagcagttccagatataggaaacctcatccccgttatcggcaaaagtgtgatgagggaataacacatctgttttataaacggaatgcacgtcaaacaaaaacattcccccggccttcagggctgcatgcacatgccggaacgtttctttgacctctgtttccgtttccaaatagttcagagaatcacaaaaaatcgtgaccatatcaaaatcatgcaggccgcaaagcgcgcgcatatcctgctgcaagaaagtgaggtgtgccccttcagccagtgcttttccgctcgcgactgtaagcatgtcttccgataaatcaacgcccgttacttcaaaaccttcccgtgcaagcagcagtgacagttcaccggtaccgcaggcaagatcgagcatgcgccttcctttgacaccatgccgctccctttgctgcttcacccactgcagccattgcggatagggggcatcttccatcaacgcatcatatacgtaggcgaaattttcgtagctcattgcaagacgctctccgcactaacagtcggtgcgtctccccaaagcctttccaaattatagtaattccgttcatcacggttaaaaatatgggcgacaatatccccaaggtcaatcagcacccattttccctcttcaaacccttccatgcgcctgaccgcagttcctgcttcttccgctttttctttcacttcacgggcgatcgcctgaatttgtttatcggaattcccattgcagatcaggaaataatccgcaatcaatgaaatcccgcgcatatcgaggaccacgatgtcttccgcacgtttatcatcgcaagcttttacgactgtttttaataacgtctgattgtccatttactccccttctttcttcatcactaaatcattgtataacgcaatcgtatccggaaaaacgggctgattccggccaattaaaaatgtaatggtatgcccggctgcatacaatactgcttcatcgagatctttggccgcaagccgccttgcttcttcgacacccggaaaattccggccgggttcaatataatcagccagatatacaattttttcaagcaacgccattccagccctgcctgatgtatggtacttgatggcatcgagcacttcccagtccgtgacgccggcttctttttccaccaaataagcgccaacaggggcatgccataattcatgatgaaaagaaagcagccgttcgtccattttctggtcgaggatgatttgtttcatttcctctttcgggcggaattttgcataatcatgaaaaatcgccgcaagttcggcttttttctgatcagcatgatattttttcgccagccggacggcgctttcagcaacaccgagcgtatggatgtaacggcgctccgtcagctgtgctttgacaagttccaatgctttctcacgttccatataaatgatgctcctttatatattcccacactgcatccggaattaaatattttaccgaccgatttttttgcagacgttcacggatcagtgacgaggaaatatgaatttccggaatttcaacaaattggacaggatacttggtctggtgcgaatatgccggccggttgacgccgacaaagcggacgagccgaacgagttggtcgatattccgccatttcggcaagtattcgatcatatccgcgccaatgataaaataaaagtccgtatcaggttcccgctttttaagcagcaccattgtgtcataggtgtaggagcggccgggcctctccatctctattccctcaatcgaaaatgccggctgccccgaaatggcaagcgtgagcattttgattcggtcatggccagtgatgccggccgttttttctttatggggcgggtcctggtttggcataaaacggacttcgtcaagtttcagatcctgcaaaatttcgttcgcgataatcaaatgaccaatatgcggagggtcgaacgtcccccctaaaatacccactcttttcatgccgcccacccttaaggcaaaacaatctctttatggtttttcgattctttataaaggacaatcgtattgccgatgatttgcacgagttccgcacgcgccccttctgcaagcgctgcggcaacagtatctttatcttcatcgcagttttgcaggacgctgattttgatcagttcccgcgcttcaagcgcctcctgcacctgtttgaccatattttcattgaccccgccttttccgacctgaaaaatcgggctcaaatggtgggcttttgcccgcaaaaaacgtttttgtttacctgttaacatgagtttcctcctagaatgctttcaacgacgtttttcattttcctggtatccggcttcacaccggtccatttttcaaacgcaatagccccctggtaaataaacatgccgaggccgttttgcacccgggcgccgcgtttttttgcttcgtttaaaaatttcgtttcaaacggattgtatataatatcagatacaaacgcatctggatttaaattgcggacggaaagcggctgtgcgtctgtatttggatgcatgccgatcgatgtcgtctgcacaatcagcgtatattctcccagctgttcttccgcttctttaagcgtaagcacctttgacgggcacggaaaagggctttcgtcccgcatttcttccgctttttttaccgtgcggttgcacagatcaacggttactgccccttcccggcatagcgtataataaatcgctcttgccgcaccgcccgcgccgatgacaagcactttttccccggaaatcacccgaccgctttcttctttcagcgcctgcataaaccccgggccgtctgtattatacccggcccatccgtgtggagtgcggacaacggtattcaccgcaccgatcgtttccgcaagcaagtcaatctcatccaaatagggcatgatcgcctgcttatgcggaatggtcacattaaatccggccacgccgattgctttcatgccgtttacggcggcttccagattttccggcgtgacatggaaagcatgatagtctgcatcaatcccgagtgcccggaatgcttcattgtgcatcgcaggcgacagcgaatgggcaatcgggtcaccgatcaccccatataaatcgcgcacatttctcactccccgttaaaaacagaacctttttcagatcaacgactggcgcagcatgacctgaacaccctttggcacataggccgcgacaacggcgcccggttcgttgaccgtcacccagccaagcccggaaaaaacaatatccgtctttccttctttaatggaaaattcatggcgaacgagcgccgggaaatccgcggcttccgcttttcccggcggctggagcagttccccgagctggcgcgcatacaaatcatccgcattttcaagttttgtacggtgaatctttaaagcatttgaaacatagcagacaaatgaacgtctgccgccctttatataatcaagccgtgcaagaccgccgaaaaacagcgtctgctgctcgttcagctggaatacggtcggcttgatttcttttttcggcgtaatcacctttaattcgttcttcccgacgaaatgcgccatctggtggtggttgatgatccccggcgtgtcataaagagaggtcccgtcatcaagcgggatgccgatcatatccagcgtcgtccccggaaaataagatgtagtgatgacatctttttcccctgttgcctgccgtataatgcgattgataaaagtggatttcccaacattcgtacagccggcaacatacacatctttcccgttccggtactgttcgatggcaaccatcgcttcatccatgccgtgcccctttgctgcgctcacaagcagcacatcaaccggacggagcccgagttctttcgcctgctgcttcatccagttggccattttcgctcttttcaccgattttggcaggagatcctctttattgccgattaaaagaaccgggtttttgcccgcgaaacggtgaaatcccggcagccaggacccgttgaaatcaaaaatatcgacaatttttacaacaagcgcatccacttgcccgagccggtttaaaatttttaaaaaatcatcgtctgtaagcggcacgtcctgcacttcattgtaatgtttcaatctgaagcagcgctggcaaatgacctgctctttttccagcgcagattttggcgcgtagcctgcctcatccggatcttccgtctggatgagcgccccgcagccgatacaatggacagcttctttttccaaattcaatcctcccaagtcaaataaccttttttcctgaaccagcccataatccggcgttcaatcatccggttgagtttcgtcgcaaagccatctgattgcgcaaccgggacgacgagaatcgtataaaaaccgcttctgttgccgccgagcacatcggtcaaaagctggtcgccgatcacgacggtttcttcctttttcacgtccatgatagcaagcgccttgcggaatgctttgccaagcggttttctcgctctgaaaagaaacgggatgccaagcgggtccgcaaatgttttgacccgcatttcattattattggaaacaatcgtgattttgatatgatgttcctgcatgtcctggaaccattggaccagttttggcggcgcactcggcctgtcccactcgaccaatgtattgtccaaatcggtgatgatggctttaatgccatgcttttttaattcttccggcctgattgacagcaccgatttcacttgccggtccggcaaaaaatttttcaagatcaatccgtgacactccattcattttaccgttctgtccacaagatgcaagcttatccgcccgtttatgagtatattgtcccgaatatgcttcattcaagtttcttttatcataacaatttctacaaattattcaactgatagcaatgccctgttccccggaagccggaaacaggaaaaaccgccgggcagtgcgcgctcagcggttttgattgctttccattagtcatgtccgtatccatgggtaaatcgcaaagctgccatgcctgctgcttgaaaatgttgcgttttttcttgctttgcgctttatactggcgttttttcccccattgcttcgatcagcaggtcggcgatatggacagcgcggacttttccgcttaaaccggcccgttcgatcccgagtttcatttgcagcaggcagcccgggttggcggtcacaatggttgtggcatgtgtcgcttttgcgttttccattttatggtccaaaatttgcatggacatctccgactcgacaatattgtaaatgccggccgacccgcagcagtggtccgcttccttcatttcccggaattctacattttcgatggcgccaatgagcaggcgcggcgcggaagaggtcttcatcacattgcgcaaatggcatgaatcctggtacgtgaccacctggtgcgggaggctgagtttccgtttatggaagcccagctctacgagaatagcggaaatatcttttattttgcttgaaaatgccgcggcccgttccgcccattccggatcgtcttttaacaaatggccgtaatcgattaaataagcgccgcagccgccggcattcgtgataatataatcagcgcgcaaatcttcgaaagccttgatattgcggcgggcaaggccctttgccatctctttttcgccgccatggccatgcagcgccccgcagcatgcctggtcctgcgggatgacaacctcacagccggcaagctgcaatagtttcaatgtcgcatcattggtttccatgaacatcgtgtccatcaggcagccggtaaaaaaggcaacgcgttttttcacttccgcttttggcatcaaatgttccgggcgctgtttcatttccttccattttggaatttttggcagcactttttccatggacgataaatttttcggcagaagctttaaagcgcctgtcgcatgcgccgctttttgcaggccgctccgctggtaaaaaccgatcaggcctgttaaagcgcgcatccgattctggtgcgggaacaattcttcaaagaccgctttgcggagcacttttaccggcagggactgcttctttttcttcgactgctggataatatcccgcgcttcttccaaaagatgcccgtactggacgccggacgggcataccgattcgcaagcccggcagccgaggcacaagtccaaagagcgctccacatcttcatccggttcgataatgccgtccacaacggctttcatcaatgcaatccggccgcgcggcgagtgcgattctttgaaccccgattcaatataggtcggacaggatggcaggcaaaagccgcagcgcatgcagttcagcagctggtcttcgtccatcctttccctgaatttctgctggatttctttttgttgttcggctgtaatcatttttccatcaccactcgatccgtttctttggcaaagactttgccgggatttaaaatatggttcgggtccagcgcatttttgatcgcattcatgacgccaatgcccgtttccccgagtttccattcaagatacggcgctttcgccatcccgacgccatgttcgccggtaatcgtgccgcccagttcaatcgctttttgaaaaatttccgcaaaggctttttcaacccgctccatttcgtcctgatcccggatatcggcaaggcaggtcgggtgcagattcccgtcccccgcatggccgaatgtcccgatatggagcccgtatttttcagcaatttcattgattgccaccaccatctttgcgacttcggaacgcggcacggtcgcatcttccaaaatcgttgtcggcttcaggcgggcgagtgcgcttaaagcgctccttcttgccgtcatgagcgcttccgcatgttccggggaagctgccacctttacatcgactgcatgttgcttgcggcaaatttccgcgatcttttcaatatcgcgttccaccacttcctgcgggccgtcctgctcgatcaaaagcactgccttcacattggtcggtaggccgatatgcgcaaaagcttccaccgcctgcagtgtcggctggtccagaaattccagcgtcgccgggatgatccggttcgcaataatgtcggaaaccgtttgcgcacacgcttcaatatcctggtaaagcgccagcatcgtcttttttgcttccggcatcggcaaaagtttcagcgtcgcttccgtaatgacggcgagcgtcccttccgaaccgaccaaaagccgcgtcaaatcgtagccggctacatctttcgccagttttccgccggtgcggatgacctcaccgcttgcaagcacggcttcaagtgccagcacatagtcgcgggtcaccccgtatttcaaaccgcgcagcccgccggaattttcgttgatattgccgccaatggtcgaaatcttcatcgaactcgggtccggcggataaaacagcccctttgcttccaccgctttgatcatatcgagcgtgatcacgccgggctcaaccgtcaccgtcagattttcttcatcaatttccaaaatcttgttcatatgcttaaacaacagcacgatgccgccttctatcgggcatgtgccggcacaaaggttggagcccgacccgcgcggcacaataggaatccggtgtttgttgcaaatttttacgattttctgcacttcttctttattgcgcggcgccacgaccgcatccggcattgactgaaactgcgggcttgcatcatacgaatacacaagcctgcccgccttcgaatcatcgtaattttccgggccaacaatttgctgcagtttttcttttatatcggcttgaatcatcaaaccttccccccgttctgcaaattttcaatattttaacgagaaaaatattgttttgtgcttcattttatgataaagctaaaagtgcaagaatgatatagataaaaatacaaagtttagcggttactattggttgatttttaaatttatatacaaaggtggtcaacatgctgttgtttccaaaaattgccggaaaaatcgtgaatgaagtgcagtcggtgatggatgaggatattattgttgtggacgaaaacggggtgatcatggcctcgacgcaaaaagaccggattggaaacttccatatgggggcacagaaagtttttcaaacgaacaaaaaattgtatattgatgaagaaatggcggcgcaaatggaaggggtgcggatggggatcaatatgccgatccggttcgaagggaggacgattggcgttatcggcgtcaccggcaatccgaaagaagtcgaacattatgcggagctgatccgccggctgacggagcttattattcaggaaaccgtccatgctgaacaagcacggtccaaaacgagggggctcgaggcatatttctacgaatgggcgacagtaaaggcgtatgaccagcatttcgttgaacggggactgatgcttgggattccgatgcaggtgcctcacatctgctgttttttaaaaatggcggtgccgccatcgggggaaacagaaatatttgaacggctgcaatcctatattgaaacggaccgcgacatgattgtgcactggagtccggggttgtttttgctgctgaaaagcgtggaagcgccgttttcaaaagaacggttttatgggcaattggaagattttaagcggcgatttgcgccaaattgcgcagtcggggtcggaaaaacagccggtacatatgtgatccgccagtcgttcaaagaagcacagaaagctttgaaagttgccggaaaaaatggcggtattgtgttttatgaagacctgctccttgatctgctgatagaagaagtgtcggaagaggcgcgccaggagtatttgcaaaaaacaatcgcgaaactgcaggaacatgcgggcctcgcagaaacattgcaagcctatcttgcaaacaacctgtcgctgaaagaaacagccgcacagctccatgtgcatattaatacgctccattacaggctgaagcaaatcaccgaagtcacgggcattgatccgaaaacagcggaaggcattgcactgttttatttggcggtacatttggcggagtagaagatttttcactgaaagcgtaacggagctgtcccaaaagccccatttaagtaggaattttgctctaacggtcgtgacacagcttctcaaagccgtttctccagagatttttgctctaatgatcctgacaaagcttctctgaaccgtttcctcgggaaaattttgctctaaacaagaaaaccctttgagaaaaagtaatttctcaacgggttttcttgtttaaaaaggacttttgcgagaactccctttctggcttatttcacttcaaactgccccatcatgccaaggtcttcatgttcgaggatatggcagtgatacatataaatgcctttaaacgggaaccgcattatcactttcaccgtatctcccggattgacgagcactgtatctttccagccctgctcatttgcaggcggcgttttgccgtttatgctcaaaatctggaactggacaccgtggacatggaacgggtgcaccatttttttcgtccccatggaagttgaagcgtttttgatttcccaaatttcgatggaatgcagtttcactgtttcatcaatgtggttcatatccatttgcttgccgttgatgctgacattcgggcccatgccgctcatcacaaatttgcgggttttgaccgcttttgaatccgggattttcttaatggttgcaagtttccttgggacgctgtaagattttgtgtatttgcctttaactttaaaatacatcagcgtttcttttccgtttttcaactggagcataccgccgtctcttagcttggaaaaatcaacaaggatttccgcgcgctctccggctgaaagtgtcagttttttcattttcaccggcgatgcaaggaacccgccgtcagatgcaatttgcgtaaatgtttggttgccgcttaggtgcagattatacgtcctgccgtttgagccgtttaaaatccggaggcggacaagaccgcgtttgactgtcaattgcggctggattacgccgttgacgagttcggtcgtgccctgaaagccgaatacttggtcgttcatgtccaatttataggacaattgcccgtttttcgtaaaacggcggtcctgcagcacgagcggaaaatcgttttttccgtagtctttcgggatatctagtttctccgaattttgatcatcgacataaatcagcccggccaggcctttataaacctgttcacccgtctttcccatcgggtgcggatggtaccaaagcgtggctgcctgctggcttacggtaaagctgactttccacgttttgcccggcaaaatcgtattatgtgggcctccgtctgcggaacccggtaccagaaggccatgccagtgtaccgttgtcacttcttttaagtcgttttttactgtcatattgaccttttcgccttttctcaccctgatcacaggacctaaataattgccgttatacccgtatgtcgttgacgtttttccagctataaattcttttttgccatgctgtgcggttaaagtgaaatccgccacatccggatccggattggtgtctttaagcaccgccggaatcggcagtgcaggatgctgcgcgtctttttgctccgcgctctttttcacgtgccaactgtaaaaaacggcacccccgatgatcacgatagccaataggataatggctgttatccatactctctttttcatattacccctgctttttgttatttttatgttcggtatcatcttaacgtttttttgtgcaggagttctattaataagttttgacgcttttgtgaacaaatttattttgaatagtatctttgttttaaaccgatttcagcagggtataatgatagtgtaagtagaaggagggattttgagatgtttgatttaatgccattcagaaggaatgaagatgttttcgaacgtatgcttaagaccttcaatgatatgtttgacacaaatgctttaacaccgttcaacggtaatgccaactcgttccggacagatattactgaaaaagaagatgcttatctcgttgaagcggaattgcctggcttttccaaagaagacattacgattgatgtgaacaataactatttaacgatccgcgcaaaacgcgaccaaatggaagaaagcaaagacgaaaaaaataaagtcattcggcaggaacgccgctacggcgaattcgtccggcagttctatgtcgacaatattaaagaagacgaaatcagcgccacccttgataacggcgtcctgaaaatcaacatcccgaagaaaacgaaagaaggttcatccggaaaaaggattgaaattcaataaaaaagagcggggactcgagggagagtctccgctctttttcaaaacgccagcgttacatccgcatcttttgcgtattcgagaaaagtgacagcgccgccgacttcagtgccgtcgataaaatcttctttcttcaggcccatgacatccattgtcatctggcaggcgatgaattttacacccaggtcttttgctatttcaacgagttcaggaatagaaggggtgttgcttttcgcaaaaccttccgcatagttttcttttccttccggcatcggcaaatttttatgcacttctttatggatgaggttcaatccttcaaatgtgaaaaagatggccacctccatgtcggacgctgcccctgccgttgcaatgttaaatactttataggcatcaaacaatccgccgttgcttgcaatgatcgctacttttcccatgtttcatctctcctcaattttgtaatgcctgcataatgccttccgggtcaaaaccgatcacccatttgccgttgatttcggtttgtggaacgccaatctgcccggttgttgcgacaagtttccgcatcatcgcagggaccctttccacatttacttctctgtaaggaatgttctgtccgtttaaaaagttttttagcatcgcgcaaaacgggcaatgcgtcgtagtataaactgttacattgttcatctgtcttctctcctttttgttttacaaggggtatctccgatgctgtttcataaaaaatcagcggttctcatgcttttatcagcggtttttggaaaatatcagcggaaattcaatacatatcagcacttcttacctatttatcagtggactgcccgaattatacagggaggggtatctggcatcccaagctatctccacgctgacatgccgccttttacatttgtgatctgcttaaatccctgtttctttaaaattttgcatgctttgctgcttctcatcccgcttcggcagatgaccaccacttctttgtctttcgaaagctgtgcggatttttcggccagctggtgcaaagggatgtttttaaattctttgatgtggttccctttgaaatctgcaggcgttcgcacatcaataaattgcttccctttatcttttaattcattctttaacgttgctgtggtgatctgcctgaccccttttgccgggatcaggcggggaatcacaagcagcacgatcaataccaggatgacaatatttaagatcgtcatattgcgcctccgctattattttttctgaatccagaatttaatcgttggtccgtcttgttcggttttcaaaatttgatggcctgcatttcttgaccatgccggaagatcattgagcgcgcctctgtctgttgcatgcagttcaagcacttcgccgcttttaattgtttcgatgccttttttcaagcggatcaccggcatcgggcaaaccagaccgctcacatccagtactttatccgcctgtacttcacctgtaacttccgtttcgcctctgtcattcacagtcgttttgctgtcattttcaatgttgcttccaaacacgccggagtatgttttccatccaccgtccacgtttttcacgtcaaaaccgttgtttttcagaatcctcgtagccaaatagccgcgcaaaccaacctggcagctgacataaacggttttgtctttcggaatttcatcgagcctgtcccttaattcgttcagcggaatattgatcgatcctttgatatggccgaattcgcgttctatcggttcccggacgtctatcaaaatcccgtcatcttcaatgatcttgtcaatttcatgccactggacatgttcgagttccccgttcatgagattggtagcgacatagccagccatgttgaccgggtctttcgcagaagaatatggcggagcataggaaagttccaggttcgtcaaatcttcaacagttaagccgcctttaatggccgtcgcaatgacatcgatccgtttatcagcgccgtccgtaccgaccgcctgtgctccgaaaatttttccagtatctttgtcaaaaatcagtttcaaggaaatcggcgtggcgcccggataatagccggcatgcgaactcggatgaatatggacgacttcgtatgacacgccaagccgtttcagcgttttttcgttattgccggttaccgcaacagagaggtcaaatacttttgcaatcgaagtgccgagcgtcccctcgtatttttcctttttgcccatgatgttattggcggcaatgcgcccttgccggtttgccggtcccgcaagcgggatcattgtcttgtttccgttgatgtaatccacaacttctaccgcatcaccgactgcgtaaatatcttcatttgaagtttgcaagtattcgttaacaacaatgccgccgcgcccgcccaaagcaaggcccgtatcctttgccaattggttttccggacggacgccgatcgccaaaatcgtcatatccgtttcaatttctgtcccgtctgataaaatcactttttttccttcatttgcaaaagcttgaagcccgttttccaacacaaggcggacgcctttttctttcaaatggttgtgtacaaggctcgccatttcataatcgattggcgccatcacttggtttgccatctctacgattgtcacttgaatcccgcgatgtgcaaggttttccgacatttcaaggccgataaaaccgccgccaataatcactgcacgttccggtttttcctgatccacaaagtttttgatgcgatccgtatccgggatattgcgaagcgtaaagagcgttttgttttctcccagccccggaacaggcggcacaatcgggcgtgcacccggggacaagagcagcttgtcgtacgtttcttcgtacacttcattggtccgcaagttttgtatggtgacagccttcttctccggatcaatttttgttacttcgcttaaagtgcggatatctatattgaaccgtttcgacatgccctcaaccgtctgcacaagaagattgctgcggtccttgatcgtttcgccgatatagtacggcaatccacagtttgcgaaagagatgtattcaccgcgttccacaagaacgatttggatgtcttcactcagccttctgagtctggcggcagcggttgccccgccggctacacctcctacgatgatcactttccttacagccatgatatttacctcctaatgatctgtctaaatacccatataggtatattggaaaccaaaaaataatttgatttttatttaacttggtatttacaaaactcattttatacccctataggtatattgtcaataaaatttaacgaaaaaggagccaattgcagccccttattccgccaagtctttcttcattttcttaaattcttcttccgtgatctcgccttttgcataccgttcccgcaatatttccaggctacggtcttctttcggatgaaccccgaaatctttttcgcttacttttttaatgccaattacaatcaaataaataattaatatgaaaatcaacagctggacgatcatgccaatcatcccgaaaacgcccatcatgccgtatccaccgtactcattgtaccacatatgcatagacaagcatcctttcatttttaattttcgctctccaaattatatttcgatcttcatacttaatgtatcacctttttctaaaaaattccttaaacatgcttatattggcctgtaatggcttccaactaattctttgtttttcgaggaatatccgcaacgtccagaacaagctgagaaatgccggttttcggtatatcatactttgatcaccgtttggggagtggggtataaggggttgtggacccaaaaagattttttatctcataattagacagtgtggattacttcattttttatcatcaattgtctctgtaacaaattttttctttaccactcgttccccgcctctattttttagatataatattagtataatttagtaaaattgccatttttaaaaaggagttttatcaatggaagacatcatcaacacctataaaaatgaccccgagtccgtataccacacttggttcttaaataatgatgatagattaaaagctttccggtccattagaaaaagcctggcaaaggttatagatgaaattgaagaaggcaagtttggaaatgattttaaaggttccagtttagaaacggtagtgacggcgatatcagaacagaaacaaatatttgaaggcgccgcccatgcatttttttggaaaccaaaactgcgtatcccggatatttacgaaaatgaggcaaacaaaaaagcgttcgggcggtttttgaaagcgtgcctgaatgcaacaaatgaaaaacaagttttggatgaaatacgtgaattgaatggatacaacataaaagggctaggaccggctgttgcaaatataatctattttttgcatccgactttatttcctccgtttaatacagccattgtgaaaggctttaatttgctgttcagccaaaaaattaaactcggctcctggcctgagtatttaaaaatgagggagattattctctttaaaaatcaggaataccgtaacatgctgtccaaagatttgggcgctttcgccggccttctctttgaaatcggatcgaaccgtttagtcatcgatgaaaatgcaaaacttgtattacaaaatgaactggataagcaggtaaaagcaattgcacgccgacataaagaagtagagaaagatatggcggaggaaaactcccattcagaaatgcaatatgatcttgccaaattagggcgggctttaggctacaaagtgtggatagcacgcaatgaccataaaagaaaatggaacggtgtaagtttaggtgagctctccatcgtatttaatttaaccgcctcatctatccggtccatgttcatttgcctgccgttaatgctgacgttcgggcccatgccggacatgacaaatttccgcgttttcaccgcttcttgcaccggcattttttcgatcacagccagtttttgtggaactttgtaggtctggtcggactttccttttactttaaaatacatgagcgtttctttcccattttggagccggagcgtgctgccgtttttcatttttgaaaaatcaaccaaaatttctgcacgttccccgggagaaagcgttaattttttcatttgcacaggcgtcttgagaaatcccccgtcggatgcaatttgcacaaatgtcctgttgccgctcagatgaagattgtacgtcctgccgtttgccccgtttaaaatccggaaacggacgaggccgcgcctgaccgttaactgcggcttcaccgcgccgtttaccagttcggttgtgccctggaagccgtacatttcatctgtcatatttaatttgtacacgagctggccgtttttgttaaagcggcggtcctgcagcacaagcggaaaatcatttttgccgtagtctttcggaatatcaaggctttccgcatgtttgtcatcgacataaatcagaccggccaggcctttgtatacctgttcgcctgtttttcccatcggatggggatggtaccagagcgtggcagcctgctggctcaccgtaaactttgctttccatgttttgcccggctggatggcagcatgcgggccgccgtcagccgaacccgggacaatgaggccgtgccaatggaccgtcgttgcttccggcaatttattttttacggtgatattcactttttcgcccgttttcaaccggatgaccggccccaaatagtcgccgttatatccgtacgttgctgttgttttcccggaaataaacgcctttttcccctgctgtgcggttaaagtatactccgccacgttgggatccgggttcgtatcttttaaaacggctggaatgggcagatccggatgctgtgccgctttatgatttgtgctgattttcacatagccattataaaagaaaacaccgccaatacccacaatggccacgattaaaatcagagcccctaactttgtcttgttcatcctacccctgctttttcttttttgatgttcagtaccattgtaatggtttttaacaccggaaatccatcgttatagattgacgattttgtgaacatctgttgtgcattggcatctttgttttcaacttttttacagtggggtataataactttgttttcaacttttttacagtggggtataataatagtgaaaaggagggattgaatatgtttgatttaatgccgttcagaagaaacgacgatgttttcgaacgtatgatgaagaccttcaatgagatgtttgatgcgaatgcgttggcgccttttgcgaacgcaaactcgttccgtaccgacattacggaaaaagaagatgcttatcttgtggaggccgaactgccgggcttctcaaaagaggacattaccattgatgtccgcaataatgagctgaccatccgtgcaaaacgcgaccaaatggaagaaagcaaagatgaaaaacataaagttatccggcaggaacgccgctatggcgaattcgtccggaagttttacgtggataatattaatgaagacgaaatcagcgccacccttgataatggcgtcctgaaaattcatattccgaagaaaacgaaggaaggcccatccggaaaacggattcaaatccagtaatcatgaagcggaggcttgtaatgcaagcccccgcttttttgtgtaaaaaagaagccggataatcccttaatccatcaaatccttcttcatttttttaaattcttcttccgtgatttccccttttgcataccgttcccgcaaaatgtcgaggcttttgtcttccctttgatgcggccggaattcgctcacttttttgatgcctgccactatcaaaaaaatcacgagcacaaagatgacaagctgggcaatcatgccgattaggctgaatacgcccatcatgccatagccaccgtacatcatcatggtcagcacctttcctttttacattccctactactgtatactgtaccactttttttttaaaaaatccttgatctattcgggcttcccttcccccctttttttgcactcttgcgcaaattcggccatcgttttctcatccatcgggccgatgactttacggatgatggtcccttctgcatcaataaagtaagtcgtcggaatggtaaccgttttgtaaagggtgccgacggagccgtccatgtcaaacagaatttgaaaagcaaggccgtttttcttcacaaagtcaagcggcgcattctcgtttgtttcggtattcgttaaattcacagcaagcactgcgacatccgggtttttttcatagaaacgctgcatatccggcatctccgctttacacggcgggcaccaggaagcccaaaaattcaggatcaccgttttccctttaaaatcagacagtttgaccgtttgccccgatagatttgtcagtgcaaaatccggcgccttttccccttcttttgcttctgcaccgccggatagcggttgtgccttcaccgcggtttcctgcctctcccctgctgttttatttttatcgggatcgtccggtttttttaaggccataagcaaaatggctgaggccagaagcacggcggcagccagaaacactctttttttcaaccgcttcaactcctttacgggtattaaagtgctttctatcatttttattcttttttacgatgaaatagaagcaaacgctataataccattatttgcaaaaggggcaggagacgctctataaaacgagatggaacccgaccggtattgcaaatgcaaaaaacgtgctgccacaaaccagtatgcggccgatatcggctgggcatccaagcaggtttaaaatacttataagctgtacaacctgctcgattcgggcaaaacgaacctggcatcccgaaatctcaacagccatgcaaagaaagcagcagggtgctttatcctgctgctttacccgttttcatttctcctatggctgcgccgggcttttgccaatgcggggagcggtttaaagcgtgcttcccggccgttcaaaaaaggagaacctttggcgttaccatccccggcttgcgccgccgcctccggaagaaccgccgccgcctttgctgcctcccccgccgccgcttccgccgccaccgccgccgcgaaagaacatcatcaggatattcagcagaaaatacgtcatggtcccgccgagaaacttgaaatcaatgaaaatcaggataaggatcccaagcccgatcaaaatctgtttccagaacgaataaggggaagcctgggcggaagagggccgctcatacgcctttggatgggcttgaagatttacattgtattctttcgccgtttcggcggcaagcttcttatacgtattgataaccgccgcatccggcttgttttctttcaaatacggtatggcatactgatcaaggatccgtcctacttttccgtccggaagcgccccctccaagccgtacccgacttcaattctaattttcctgtcttttactgccactacgagcaataccccgttgttcatggttttattgccgagcccgtactggcggaaagctttgttggcgtaagcatcaatgtttgtgtctttcccggtcgtgtccacagtcaataccgcgacttgcgcttttgtttgctcatctagctgcctgccgagcgaaacgagctcctgtttctggctgtctgtcagcaccccggcaaaatcctgcacatagatgtccccggccggtttcggaatgcccgctgcagcacgcgcactgggaacggccgtgcatacggcaaacagaaaggcgagaaaaacggctgtaataagcgcggcccttttcatcactgatcactgctgtccccaaaatcaactttcggggttttctttgcactttcatccgctttaaaatattccttttcctcaaaaccgaacaggccggcaataagtgcgccgggcattcttttcacctttttgttatacgttgcgacggcgctattgtaatcctggcgcgccacagcaaggcgattttccgtgccggcgagctcatccatcagctgcgtgtaatgttggtttgcttttaaatccggatatttttcaaccaccaccaacagccgtcccaacgcgctgtccaggcggtcgtttgccgctgcctggtctccgggtgtttttgccccggccaattgtgcgcgggctttcgaaatgtcatctatcaccgctttttcatgggaagcatagcccttgacggtattcacaaggttcgggatcagatccgtccgcctttgcagctggttttgaatttgcgaataagattgatttacgttttcttccgcattcaccaagctgttataacttgtaaaaacgctgacgatcagaaccaccaatatggcggccacaatcatccatggcatccacttcttcatatacaatcctcctcatttatgcttataaatccaataccctgtcagcagcattgaaatgccaggcccggcaaaaaaagaaagtatgtaccggccgcctaccattaagatacggaatgtctgcccaaaagtttcatgcttcaggtaaaatatttcccgagcaggatgcctaaaaatgccagggcaatgccgaacagatagctcagcacaaggtacggaacaagaatatgatattttttgtcagcctgcagctgaatattctcaagtttaaaagtggagaaagttgtaaaggcgcccaaaaagccggtcccgagaagcaggcgccacgaactcccggcacccgtgccaaacagaaggccgagcataaatgagcccgaaaggttaatgaaaaatgtggccagcgggaattttgccggaaacgcccggttgatccaccgcgaaagagaaaaccgggaaaccgccccgaaaaaggcgccgattgcgataaaaatgccgtttaaaaccatgaatccgcctccttcatgacgctgtatctgaaccgcctcttccctttagccgcgaatgcagcatcccgcctagtttaaagccggtccatgacatgaacagcccgccggataaactgcagaaaacatataacagcgcggcaaatgcatgcgattgccggataagctgcaccgtttccacgctgaaagtcgaaaatgttgtaaaggaaccgacaaacccggtgccaagcgcggttacaatatacggatgaatcttgccggatttaaaaagatgcatcgtaagccagccaagcagaaagcagccggccagattgatcgcaagtgtcggatatggaaaaacggcatgcgtgtacatgccgatccatatgccgaaataatagcgtgccaaagcgccgaaaataccggcaaccccgacccaaatatatagcatacagctccctccagtccattgcggcatggaatttgccccctgcgctgcttttttcgtgaaaagagttcccgtgccgtgcctaaaggttcgtttattttgtcaaaagccttgccagcccaaatgcagcggcagcggccaaaccgccaatcacaacggtctcaagcccgctcttccacacattggaaccggtaaaccgccctttcaccgccccgaaaataaacagcacaacgagcgtcaccaggacggaaacaagcagggcctgtgatgccctggtgacaaaaaagtacggggaaagcgggatcagcccgcccacaatatatgacagggcaatcgttaacgcgctttttaagctgcgccccttttccggcttctcaagccccagctcgaatttcatcataaaatccacccatttatcagggttttccgccattttatcgacgattgcttcgatttgttccggtttcagctcatatgccttaaatacatcccggacttcgtctttttcccgttccggcacctcttctacttcccggtattccctttttaattcgctataataatgctcggcatccgattttgctgccagatatccgccaagccccatggcaatggaaccagccgcaatttccgccgcgccggccgcgagaacgagcaccggcgaatccactgcaccggataacccagctgcgagtgcaaacggcacagtcagcccgtctgacatgccaatcacaatatcacggacggtgtcagatgcctggaaatgttcctcaacatgttcatattccgacattccttctcttcctttctgtctttataggtcttattgtagcatttcaagccggaaatgggcgaaaatgaacataaagtttactttcttgtaaaagtttctttgcaaactttagaaatacgcatataatgaacttaacaactgacgtccgtccaaaagcctgtttcccggcttttggacagcatgtgtaaaaggagccaataaaatgtcacacggccatggacaccaacaccatcaccatgaaccggcacaatacggaaaagctttcgccgccggcatcgggctgaatattctttttgttgcggttgaagccatttacggtttcttttccgattccctttcgctgttggcggatgcaggccataatctgagcgatgtgctcgggctcatcattgcttgggccgctgtctggcttggcaaaaaattgccgacaaaaaagcgcacatacggctataaaaaatcatccgtgatggctgcgcttttaaatgcgattattttgctgattgcgatcggcgcgatttttgttgaagccgtccagcgttttgcccatccggaacctgtcgcaggcaaaacggtcatgatcgttgccgtgatcgggatcgttattaataccattaccgctttactgtttatgtcaggaagaaaaacggacctcaacatccgcggcgcttttctgcatatggctgccgatgcgcttgtctctctcggcgttgtcatcgcaggtgcgattatcctgtttacaggctgggagtgggtcgacccggttacaagcatcattattgcgattgtgatttttgcggggacatggggcctgttgcgggaagcagccgacctttcgcttgatgcggtgcctgcaggcgttgatgctgatgcgattaaaacctatttagaacaaattccgaccgtgctcaacgtccatgatttgcatatctggggaatgagcacgacagaaacgatattgacggtccatattgtccgttcgcaaattgaagacaacgacctgctgcttgaaaaactggaaaaagaactgcatgacaaattcgggatcgaacacgctaccatccaaattgaaaaagggacatatgtttgcggcctggcgccggacaacaaagtttaaaccggaaaacaaaacttacggcaattcaataagcatgcccggcacatgaagccggatccagcatgcaaaaccccgatggaagcaagcggtttacctcataaatacgccttttgcccggattttccttttgtaccggcaaaagaaaaaaggctgccactgcgcagtcttttttttgtccctttaaaagcacaaaacttttcgacagatttctacattctccgttgctgtggatattcttatacacattttgcacaaagtaacaccaggccttctcacgtttataaacaatttacccacaagatataaacattttactgtggataaaagaacgcttgttccgcaaggctaaatttggtaaagtaagaatacaaatactctctctttatgatacgcaggatgcttaaaaaaaagaacaacattttcagaggtggtacagatgtataagttatctgatgaactattgatcgagtcctattataaagcaaaagagctgaaattaagtgccgagtttgtgaagctgattgaaaaagagattgaacgccggtccctgacccataaaatcaaagcaacgtcctagccacttttgcttgatatgtggctttttttgtgtgatcaatcctttttttcttgaatatatatataaataaatggcagttgggaggtttgcgggggtggactttgatcattggtatgatgctatcttgaattttataaaatcgcaagccgccaatggattgacagtggcaaacggatgctgcggtgctgcagcgcttttttattgcggcaatcatcagccggcggtttccgcagccttgatctttgccgctgtattgttcgaccgctatgacgggaaactggccaggaagttaaaaatggaatccgcgcttggcaagcagcttgattccctttgcgatttgctttcgtttggcgccgcgcctgccatgctgatccatacagcgctgttttgcctgtacggggttccgggtatgttggccgccattttttatatgctttgcgggatgatccggctcgcccggtttaatatcagcaagcaagagggatttttttacgggcttccgatccccgtggcaggcttatgtgtaacggccggtttttttgccgttccttatgtcacccacttctggttgtttgtgtggatggtgctgttgtcggtcctgatggtggcgccgtttaagttaaaaaaaatatgaaaaaggcgcactgcaaattttgcaatgtgcctttttcattattcgccgttttgttcctttcttttttctttctcaagccggtaaaattcgtggaacattttcatgagcgcccgcttttcaatacgggatacgtagcttcttgaaatgccgagctccttcgcaatttcgcgctgtgttttttccttttttaaattcaggccgaatctgccgatgatcacctgtttttcgcgttcatccaatatgtcaaagaattgtttcactttttccagctccatattcagctggatcgtgtcaaatacgtcttccgcttcagactggagaacatcaattaacgaaatttcatttccttccttatcttggccgatcgggtcatgcagcgaaacatctttttttgttttctttaaagctcttaaatgcatgaggatttcgttttctatacaccttgctgcataagtggcaagttttgtccccttcccttccgaatagctctcaattgctttgatgaggccaattgttccgatcgagataaggtcttctgtatcttcaccggtattttcaaattttttgacgatgtgcgctacaagccgcaggttatgttcgattaaaatattccgggcatccgcgtcgccttccgccatccgcttcaaatatttccgttcttcgcttgccgaaagaggttgtggaaaagcattgtttttcacataggaaaccaaaaaaacaagctctttcatcatatagcttaccgctgttaagatccccgacatccttccacctccattaggcttgagcctatatagttcaaacatatgaacaaggaggcggaattgtgtctgtcccgaagaaaagacggctggtaaatattgcacgacacttaaaaaacaaaaaaagttgtctcaaaatcgcaaaacggctgatgggagcttttatttttgcaagggatgataaagttggctgtttgatcgcggcattcagccactattctcgggaagcgtttcgtaaaatacgcggccttccgcccaaggagtgacatacatgtaaaaaccgcattacagcgcgctgtaatgcggttgggttgaacagattccttaactgtgtacagcttcatccgtttttgtttcccggatgatgtaatcaaaagcaccgagcgcagctgtcgcgccggcccccatcgaaataatgatttgcttataagcgctatcggtgcagtctcctgcggcaaacacgcccggaacactggtcgcgccgcgcttatccaccacaatttcaccccgcggtgtccgttccactgtatcgccaagccattcggtattcgggacaaggccgatttggacaaacacgccttcgagttcaatatggtgttcttccccggttgcacggtcaatatatgtgatgccgttcactttatccgttccggtaatttctttcgtttgcgcattttttacaaccgtcacattcggaaggctgtaaaggcgctcgagcagcacacggtccgcctttaattcaggcataaattcaatgacggttacatgtttgaccacaccagcaaggtcaatggccgcttcaatgccggagtttcccccgccgattacggcaacatgtttaccggcaaacaacggcccgtcacagtgcggacagtacgccacacctttgtttttgaattccgcttcgcccggcacgttgatgttgcgccagcgtgcgccggtggaaatgatcacggttttgctctttaatacagccccgttttccaattcaacctcaacgagatctttcttttcgacccgttttgcacgctgcagattcataatatcaacattatactgtttgacatgttcttcaaggtttgcagcaagttgcgggccttccgtatacttcgtgccgattaggttttcaatgccgactgtatcgaggacctgcccgccaatacgttcagcgacaatccctgtccggatgcctttgcgcgccgcataaatggctgcacttgcgccggacgggcccccgccgatgacgagcacatcaaacgggtctttcttttcaaactcggacggatccgctgtgctgccaagtttggcaaggatttcttccacttccatccggccgctttcaaagaattcgccgttcagataaatggaagggacggccataatgccttttccttccgcttcctctttaaatgcagccccgtcaatcatcgtgtgcgcaatattcggattgagcacactcataatgtttaaagcttgtaccacaacaggacagttctggcaagtcaggctgacataggtttcaaaatggtattcgccttttatgctttgaatctgatcaatgaccttctgatccactttaggagggcggccgctgacctgcaacagggccaaaacgagcgaggtaaactcatgcccgagcggcacgcccgcgaatgtaatcccggtgtcttctcccggccggtttacactgaaactcggggttctttcgagttttgtgttttccacttttatccggggcgacatggcggccaattggtcgaccagttcgagcatgttccgcgatgtttcatcggaacccgcgctcactttcagcagaacgtcgccctccatcatttgcagatactgggccagttgcgctttaatctcttcatccagtatcatatcgttcagctcctcagattttgcctacaagatcaaggcttggtttcagtgtttcacccgtttctttccattttgccgggcatacttcgcctggatgctggcgtacatattgtgcggctttcactttgtcgatccaaatgcttgcgtcgcggccgatgccgtcagcgttgatttcaaccccctggatgacgccgtccggatcgatcaggaaagtgcccctgtcagcaacgccttcttcttcgcgcaatacatcaaacatacgggtaagtttttgtgtcgggtcgccgatcatggtgtattcgattttgctgatcgcttcagaatggtcatgccatgctttgtgaacaaaatgagagtctgttgaaaccgaatagacttccacgccgagttcttttaaagcggcataattttcctgaagatcttccagttcagtagggcagacaaatgtaaaatcagcaggatagaagcagacaatgctccagtttccattgaaattttcatccgtcacttcgacaaattcgccgttgcggtatgcttgtgctttgaatggttcaatttttttgccaataagggacatcgtgcaattcctccttaaaatcatttgtgtgaatgatcacggtttgccggcccggccagcaaacaataatcattttaattcaataccaattattatatggaattaatttcttgtcaagcaattacacccggatttctattttatcgtttccggattttaaatgatatagtcataaaaccatgatatttatgttttttatgctgtttccgcctctttttttcacctctgtaattgaaaatcagggcagataattgaaattttttacgcccagagaccgccgctctcccatttcagtattgagaatgcttttcaatagatagatgtcaaaaaagccggtggccggagccatcagctttttcttttccgcctgtggaaaacagcggtaaaaatcaaaatatgcaaaaacatagcgccatcccctgatccggttttgctaggtggaatctgtctccataaagataaagtccaaacgtttctgataacgggccatcgtcaaccgctcctttcttcaggtgttttttcagcttaaaaatgccttgcttggaatgcctcacgctttgcattcatttcatcgtacagcctgaaaacttcttcatcacgctgcctttgttctgccgtctttttcagccgtttaatcgtgacggtaataaagattaaattgagtgtcatatttttccacctccttaagggcgcaaaaaaaccgcaggacaggcatgatcccgcggctttccggaaaaaaaccgcacggatcaggcaaatgcatcctgcggcttgtgcgtcaagttaaaaaatcagcgcaaattcaaaccgatacggagcggatgcagaacatgttcagttgcaactgcagaaaataggattgtgtatgccatgttcttcaacctcctttgaatttgcttacataggaaagtatatccaattccggcgggtttgtaaaccgcaaattggcaaaaaaataaaaaaaggccgaaaaccttgtatgccggacaaccgtgtgcttcgttactgcaccgcccgcgttacaaaggcccctgccttttcgattatgatttgcgattattccgctgtaaaagctgtgcgccttcttcgctttttaaaagctgtttatggtaagcacgtgaaatcgagaaaaacaaaacagatacggcaacaaacccgcttgaagcaacgagtaaaatttttgtccccagttcggatttcccttcgatcggcatcaccgcacccaaatataaaaagcccgtcacagcaagcagcacgatgccgtacattttaaaatccaccattttcacatacatcgatttcgctttcttcaaccgcctcaccctttctatcaatctgctaaacctactctatcacagatgaaacataaaaaagacaagtaattacaggaaaggaaggaaaaaaatgggtctacagattttcaacaatacccgtgacaagatgggcagagttcacggccgccgtttcaagatattcatcaaaagagatcccggactcctgccctgcaatatcggaaagggagcggatgatcacaaacgggatgccaaattgccatgccacttgtgcgacggcaacggcttccatttccaccgcctgcacttccgggaagtgctcctttacagtcgccgttttcgcaggatcatccataaacgagtccccggtagcaatcagtcctttcacaacctgaatgccaggcagtttccctgcgcagctttccgcaatccggacaagtttctcatccgccaaaaaagcgggcggcatttgcggcacttgcccgtattcatagccgaatactgtcgcgtccacatcatggtggcgtacttccgttgaaatgacgacatcgccgacgtgaagggcggggtttgcgccgcctgctgaaccggtattgattaagcaatccggcgcgtatgtttgcagcaaaaggccggtagaaagcgcagcattcactttcccgatgccggatcgaagcaagatgacatctttccctttcatttttcccgccgtatattcataaccggcaatcgttttaacttgcgggtgctcgatctgcccgcgcaaaatcgacacctcttcttccattgcgccgatgattccaattctcatatgactccctctttcgtccaaaagttccaatccccattatatagcaaaaaagcagaagtggatacggcttgccaaaaaaacaacgtctgatacgatgaacatggaggtgtacgaaaatggcatttgagcttgacaggatagaggataagattgaatttttcgaagcggaccggcttgaggcgctcgagaaaaaaatcaatgatcaaatcgaagccaataaaaccttgctgctccgggtggcgtccgtttcccaccaaatgcagtttgacgcggacggcagaccccattattccgcggtcgtccattttacggcacaaaaataagcggcacagacggccgcttattttttatcgttctcgatcaattcatacatctttgtgggtttccacccttttccgtccacccatgtcaaataaacacggtaggtcgtatcggcatttttcgcggaaaccgtcccgatcgcctcatcggtcgttgccccgtgttccaaaaaccagaccgtcatattgtcttccggtatgcctgttgcatacgacaatgccttcagcttttccttccagtcaagggaagtggacgaggcggaatagacatgtccgcctgtttgttcggttccgaccggtttccagctggaatcggtaatgacttctttcacattcggttcattgcttttttccactttacgggttgattttttgctgtctttgtccgccgtttttttggatgtatgagatgatgtcgtttcatggccggatgaagcagtctttgttacggccgctttcttttctttcggtgccggttttgagttgtcgttcccggcgaaaaaaatggagtaagccacaatacaaataagcgcgatgacaatcacaatcagtgtatttaaaatgatgtttgttttccgccgttttgactgctgcatggcctgtttccgttcttcacggctgtaaaattcaggcaaggtcatccctccacttcatggccttatcataccacggttttaccgaatcgaaaaggcgcacaaagaaaattcggcgggcatggcccaccgcaatccggatgtgataagcgtttgcagcaggccgtatcctttacaacttgcaccttggaacacctgcgcacccgctccggattattgaatcgagatgattttgactctcatatccccgcccggcgtctgaaccgtgacttcctctccgacgcttttcccgagcaggctttttgcaatcggggaatcgtttgaaatttttccttcaaacggatcggcttcagcgcttccgacaatcgtgtacgtttcttcttccccgtccggtagttccacaaaagtaacggattttccgagcgataccgtatctgtcccgtcatcttcaatgattttcgcgttgcggatcatgttttcaatcgtcgtaatgcggccttccacaaaagcttgttcttctttcgcggagtcgtactcggaattttcggaaaggtccccgaaacttctggcaatttttatccgttcgacgacttctttccgtttgaccgtttttaaatattccagttcctgttccaatttttctttcccgtcctgggtcatcgggtaaactttttcctgagccaaatcccttcactcctatatctcttagttatcaaatgtgtatgcgtttcaacatacaagatgacgctttctgcaagcggctgtgttttttccaccatgttgtttagcgcgccgaaaagattccggcgcgctcaccatgtattctaaataatcgtattacaaaaaagacttttgttcaaggatggattgcaattttgtcacgaccaaatcaatcgccacccggttttgcccgccttccgggataatgacgtccgcatatctttttgtcggctcgatgaactggttgtgcatcggcctgaccaccgtaatatactgctcgatgaccgactggagcgtcctgccgcgctcttcgatgtcccgttcaagccgccggatgatccgcaaatcggcatcggtatcgacatacagcttaatatccattaagttgcgcaatctctcatcttccaatactaaaatgccttccaaaataatgacatctttcggttccacatggatggtgcggctagcgcgcgtatgtttggaaaaatcgtaaaccggtttttcaattgcctcataagaaagcagtttatgcaaatgctcaattaacaggtcattatcaaatgcaaacgggtggtcataattggttttcagcctttcttcaaacgggagatggctttgatctttgtagtaaaagtcctgttcaagtaccagaatggagtgtcccttcaagctttcgtaaatcgcccgggtaacgcttgtcttcccggacccggagcccccggccacgccaatcacagccggctttcgttccattttcttcacctcttcatactgactgccaatccatctccgactgggaaaatcgcggtgataaattgctcatgttgcattaaccattcgttgtagcttctgattttccgcaccagattgctgacttgtttctttgcgatgaagtcttgtaccacaaggcctttaaatagcacgttatccgtgtatacacatcccttttcccgcagcaacggcgtaaacgaatcaaaaaatttccggtactgcccctttgccgcatcaataaagatcgcatcgtacgggccaagttcccgggccttttggatgacgtcagaagaaagtgcatcccctttcagcaggcggatccgccgggataaaggagtgcgggcaaaatacgcatttgcctgggcaaccctttcttcttcgcgttcaatggtgacgatttttacatctggaagcgcatctgccattttcagggccgaatacccgatcgccgtcccgatttcaagcacgctttccggcttttgaatccttaacaactggcagagtgtttccactccgatcggatccataatcggaatatgctctgattttgcaaatgacgccatttcttcaaaaagcggatctttcttttgcatcaactgttctatatacgcttcgacagggccgttcatcgctgggccctccggcataaacacatttccataacttctccctgcttctcaaaaaaattccgcttattatcgtagcacatttcaaacgggaaagcgaatgtttaccgtttcgccttcgcaatgtacttttcctttaaagcattatgttccttcaatgtcttggcaaaatagacttttcctgtatccacatttgcaagaaaatagagataatcggttttttcgggcttgagcgcagccttgatcgattgttctccgggacttgcaatcgggcccggcggcaggcctttatgtttgtacgtgttataaggggaattcacccgcaaatctttatacgtcactttttctttatgccggtttaaagcatacagtacggtcgggtccgtctgcagcggcatattcttctttaatctgttgtaaaagacgcttgaaatttttgccctgtccgctttttcagttgcttcttcctcgataagtgaagccatcgtaagcagtttgtgcggcgttaaacgggcctgtgtgcttttcccagcgtaagcggaaaaaaccgcatttgttttagccaccatcgtttccagtacggcatcaagcggcacatgctgatcataaaacgaataggtcgccggaaaaaagtagccctcgagcggatgccggatctgctgattgaaaacttcttttgtcacaaggcgcggatattttttcatcaaatgttgtacaaaagcagggtcatctgcccgcttgagcacctcttctttccggaaggagctgtgtttttggatgatctccgcaatttcctcaaggccggccccttccggcacggtaaagcggatcatggcaatgccgcctttttgcatgctgctgacgatctcgctcgtatccatggacggcgacatttgataggtgccggcctttaaacccgactggtggtgggatttcgcataaattgcaaaagcccaggcatttttgataatcccgtttttttgcaaaatatgcccgatctcttttaccccggagccgggcggaatcgtgacgagttttgtcttatggcttccaggctccaccggtttcagcgccgacacgtaaaaaagggcagcccctccaaaaacaacaacagccagcatgatgatgcatgcggctatccataatttcggtttctgcttcattttttgaagcaacagttgaaacggatttttctttccggccaaaacagaatcttcctctcaataagaaaaatcttaaaacaagtacagaaagccattttcgacttttttcctgtccattatactacaaatttcgccaagttttatttcattttcttttcaaaagggaaagtcttccattccggcagatggaaaaagcacacggtttgtcccgtgtgcatgttcaagatgcgtttatgcttcttcttcatcgagaaacgtattcagcatttcctcgatcatttcccactcttcatctgtttcaatcggctggagatccccttctgtgccgtcttcattttccacataggcggaagcatggatttcgatgctttcatcctcgtcttcttccgcgccaatcggataatacaggacgtacgattttccgaaatcttcggattcaaacgtaaaaagcacttcatacaattgttcgtttccgtcttcgtccactacggtaatatgctggtggtcttcgtggtcatgttcatggttatgtgtcatttcttcaccccgttaagtttgactgtcaaggaatccttgcaaaattacacttgccgccattttatcaattacttttttcctttttttacggctgacatcggcttccagtaatattctttccgcttgtgccgtgcttaaacgttcgtcccataaaataacgggcagattgagccgtttttttaattcttcggcataaacctttgaggcctctgcccgtgggccgatcgtgttgttcatatttttcgggaatccgacgacaattttttcgacgccgtggatttgcgcgagttcagcgaccctgtcgaaaccgaatttgccctttgcttcattgatggcaatcgtttcgatgccttgggcagtccagcccagggcatcgctgaccgccacaccgacggttttcgaaccgacatcaaggcccataattttcaatttgatcccccgcgatgttgtttcaaatacgatttgaccagttcttcgataatttcatcccgttccagtttgcgaatcatattccgggcatcctgatggcgcgggatataagccggatcgcccgagaggaggtatccgacaatctggttaatcgggttatagcccttttcctcgagcgcgctgtatacatggagcaaaacttccttgacctcgtgttccgtcggttcttccggaaaattaaacctcatcgtttcatcgaatgagctcattatcgcagcacctctctactaaagcttggttttttagatgttccggtttacacaaattttgaaggtgcattttccgctttctgcctgaaaacgatccgtgtaaacaaccagctttgtttcattgtacactactttttgcttgaatcaaacggattttacccattcttctacaatttgtaatgcggcatcaatttgttcaggctgtttgccaccggcctgcgccatgtccggacggccgccgccaccgccgccgcagcgcgatgccacttcttttacaagcttcccggcatggtaccctttttcgacaaggtctttggtgacgccggcaatgaagctggcttttccttctgtcgccgcagcgaggacaataatgccgcttccgagtttttgttttaaatcgtccgccatattgcgcagttggttcatgtcgccggcttcgactttcgccgcgagcacatttatgccgtctactacttttacgcggtccacaagcgatccggcttcgatattggcgagttttgcggccagggatgcattttcacgctgcgcttctttcaattcctgctggagggcgtcgatccgatccggcaattctgttggttttgcttttaatttggcgcttgcctcttttaaaaggtggagctgttcctgcatcaatccgtaagcatattttcccgttaccgcttcaatccgccttgtccctgcaccgattccggattcggaaacaattttgaacaggccgatctgggctgtgttcgaaacatggcagccgccgcacagttccaggctgtagtcgcccatttgaacgacgcggacgatctccccgtatttttcgccaaacaacgccatcgcgcccatcgctttcgcttcgtccagttttttcaaatccgttgtaaccggcaggcttgcccaaattttttcattgacgatcgtttcaattttttcgagttcttcttctgtcacctgcccgaaatgcgagaagtcaaaacggaggcgtccaggttcgacaagcgatcccgcctggttgacatgaacgccgagcacatccttcaatgcctggtgtaacagatgggtagcagagtggttcttttccgtgtcacggcgttttgctccgtccacctgtgcaaatacttcctggccggttttgatggtgcctgatacgacaacgccctgatgcaaattttggccgttcggcgctttctgcacatttgtgacctccactttcagcccttctgctgtcaaggtgccatgatcggcaatctggccgccgctttccgcgtaaaaaggggtttgatctaaaatgaaccggatttcctctccgctggcagccgactccgtgatgtcaccgtcttttaaaaggacagcgacatgtgccgtcccctccaggtggtcataaccgataaattcgcttttcactgtaatattgccgagcacgccgccttggacggacatcgattctgcctgctggcgggcgttgcgtgcgcgttcacgctgccgctccatttctttttcaaagccttcatggtcggcacggagcccctggtcgtgcgcatactcttctgtcagttcaacagggaagccgtacgtatcgtaaagcatgaaaatatcttcacccggcagctgttctaagccgtttttctttgccgccctgatccgttcttccaaaatggaaagcccttcgttcagcgtttcctggaaacgttcttcttcggaacgaaccactttttgcacaaaatcggcatttttttccacttccggataataggaattcataatccggccgaccgtcggcacaagcttgtacataaaagcgccgtgaatatcgagctgaatggcgtatcgaaccgcccggcgcaaaagcctgcgtaaaacatagccgcggccttcgtttgacggcagtgccccgtccgcaaccgcaaaggcaacggtgcggatatggtcggcaattactttaaatgccgtatctgcctctttgtttccggcacggtattttttaccggagattttttcgacctcttgaataatcggcatgaacaagtcgctgtcatagttggtatcgaccccttgcagcacgcatgccatccgttcgaggcccattccggtatcaatgtttttcttcggcagctccggatactcgctgcgcggaacccctggtatcgcattaaactgggataacacgatattccagatttcaatatagcggtcgttttccatatcttcctgaaggagccggattcctaaccgttccgggtcgtatttttccccgcggtcgaagaaaatttccgtatccggcccggatggcccttcgccgatttcccagaaattgccctcgagcgggataatatgatccggggacaccccgatttttttccagcatgcaatcgaatccaggtcatcgggataaacggtgacatacagtttttcttttggcatgccgaaccatttgtcggaagtcagcagctcccatgcccaggcaatcgcttcttcacggaaataatccccaatcgaaaagttgccgagcatttcaaaaaatgtatggtggcgcgctgtttttccgacattttcaatatcgtttgtccggattgctttttgcgcgttgacaatgcgcgggttttccggaatgaccgtgccgtcaaaatatttttttaaagtggccacaccgctgttaatccaaagtagcgacgggtcattgaccgggatcagtgaagcgctcggctcgactttatgccctttttccttaaaaaagtccaaaaacatgctgcggatttccgcacttgatcttttcttcatgagaaaacctcctctgtttatttatgaaaaccggaaccccccggacgcaaaaaagcccccatcccggacagggacgagaggcttgctcgcggtaccaccctgattaaaggcaaaaaacgcccttctctttgggtgcctgtaacggggcaaaacggcagggtttggctgcactccggattagcgttctgttatccttcattttggaatttctttcagccgcggaaattcctctctgggccgtacatcacggtttaaaatgggcgataacatactcgatctttcttcgttttttgatatgcagttctatcaataggaacggcctgtgctgcgcaattcccaagcccggacaaaaatccctgtccggaagcctattttgcccacaggacacgtatgttcatgggtaaattataaaaaagtttactccggtttgtcaacttgattcgtgcggcctgaaaagcgcaaagttttgcgagcatggatgatggccactttcagcacggcaagcgccggcacagcgagaatcagtcctgcgatccccgcgatttcctctcccgcgatcaaggcgatgatgataaacagcgggtgaagatgcaaagatttcccgacaataaaaggggaaaggatattgctttcaataaattgcaggacgaacacaatgatgaccacataaaggacaaattttaatgaaatggtcgccgcaataaccgaaacgggaatggcgcccaaaacagggccgaaatacggaatgacattggtgaccccgatgatgataccgagtaaaatcgggtatttcatgccaaggatggcaaatgcgacaaaagaaagaaagccgatcaacaggcagtccaaaagctggccgcggagatagccaccgatcgaccggtcgacatcgcgaataaatgctgcagcggacggccgccatttttccggcgtcaatgccagtgccgcttttttgacatgttcaaaatctttcagaaggtaaaatgaaataaacggaatgacggcaagcgcaatggcgtaattgacaagttgcatcagcatattgattgaatttgaaacatttgcagagagccataattcaaagcgttcaatgcgctcgtcaatctggtcctgaagcccgtccggccagtgcttcatcgatgtttgcaagtaaacaacgccgtccctgtactggtctgcaaactgcggcagatgttccgacagatcgttcatttgggcgatcacaagcggcagccctctgtaaacgccgtaagcggtgccgccaaaaaacaaaatatagataatcaggatggcaagccctctcggcagcccgtttttataaagaaattcaacaagtgggtggaggatgtaagcgataaaaccgccgattaaaagcggcaggcataccgccagtacgacgcgcaatacgggcgcccaaaaaggcttgagtaaaagcagcacatataaaataatcagaataaataacaaccaaaacaatttatacagccatgtaccgcgaaaccgttgcataaaaaaacctccctccttcaagtgtttgcgaaagagggaagtttatgaggatttttatcaccggtccaatgcagcaacctttgggacaactgaaatacggaggacgcaaaaccttataaacgagaacaccgggcttcgtgaaaagggatgcagcgggacagggatatccgcccatttggcaagatgcatccgtgcgtttcctttcgtccgttggcgtccggccagggaaacgagaccggggtttttatcggataggcggttttaacggaatgccttgcgcacccgctttgccattttccgcatctgccgcctgtccgcgaagccattcttcgccatctgggcagcggccattcccgcaccaaaaccgactgcagccatcatcattttgttcatttccccattccctccattcagctgagtttgcgtgcttcttcctcaaacaaatcatccaaagagctcaatgtgccgtcttcttccacctgatgcgtatggattgtattttttgcaaccgatagttcaataaaacagttccagcagtaatactggttcacgccgatttttccgatgtccttgcttcggcaattcgggcattgcatggtaagcacctcgctttcaaggtccatttttgcttaccaatatgcccaatttttccaaaaagcatacgtcaaaccggcatatatagtttgccggagcggactgacagcatgcaaggaaacggttcccagcgtatgatcgtccattccggaaaaaatataggaaaccaacagcaggaagtgacatgtatgcaaaacattaaaccgcttttgattaaaatcgccgggcattttatttttttgtatttggtgctcggcttcatttacggcatgtcttttttcggtgtgctgtttacagcgctcttgcttagcgtgatttcttattttttggctgatcttggccttcttccgcgcacagcggactggtttgtactgatcttagactttgggcttgcattttctgtcatctgggggatgactcggtttttcgcccacaaccatttgccggggcttcaggtttcgatcggtgctgccgtcgtcatcagcgtattcgaacatttttatcaccaatatttaaccgactatgtgctccaaaaaggggttccgcggcggagcaaagcacaaaccctccggtacggcacggaaaccgcagaggaaatccgtccggaaacgggaaagaaacagcaataagggcttgccgggatgtttaaaccggggtttcgcaagccctaatttttttgtttttcttcaaaaggaaccggcgtcatacagcgaaaagcgaccggtgatgacagtacgatcgatgtgttgatgtttccataaggggtgagccggtcaatcagcttgctcagatggtccatagaggtaacggcagctttcagcaaatagctgacagcgcctgtcaagcgatggcattcaacaatttcgggaacctgcacaatccatttctcaaattctgtataagtggacatcttgatctcacttacctgcatgtaagcaaccacttccctgcccacagctttcggggatacccttgcgctgaatccttcgataatccccttctcctgcagccgtttcaaccgttcctaaatgctcgggcggctgagggacaatttcttcgataaatcacttaaagtcatgcgcccatccttttgcagcatttcaagaagacgaatgtccaactgatccatgaaaaagccccctttgcaaaatgcagtttgcaatacgaaaacttattcaaaatagaaaggtttacacccgaaattgatacagtttattatttcgtttctttttgcaatcatttatgatggattccgacacaaaatcttataaatttttagatttaacatgatgttaccgcttttattctagcgcatcgtttctggtgcaataaagtattcaattgcaatgatttttaggcggcggtccggtgaaatataaacgctgtcaaaataagtgcagaaaaccttttcttttacacttttatcactatatccacagtacaaatagaggtaatctgaaatgaatgtgatcaaaccgtatatgcaaacaacggaaacattgctcgataaaatgcaggaacatgaacaaattgttttttgtaatgatcctgcaacaggtttgaaagccattatcgcaatccataatacgacactcgggccggcattggggggctgccgcatgcagccgtaccggacgctggatgaagcgttggaagatgtgttgcagttatcgaaagggatgacctataaatgtgcagcggcggatgtcgattttggcggaggaaaagcagtgttgatcggcaacccgtcaaaggataaaacccccgccatgttcagagcttttggtcagtttgttgactccttatgattgcctgtgtcatcgttttagccctattaacggccatatccatctttaagtttaaaaacgccggggataaaagtgtccaaatcagccaggtccaacctgccagaaaacttgatccttgagccaaaccaaaaagcagcggggcctgccgctgctttttggttgcttaatccggttgggacgcagtctgtccttcttctgcgtacgtgtacggggtaatgcccgccatgccaatcatcgggtcgacccggtcccaattttcttctgttaaggacagggctgtctccgtccctgcctctttttgtgccgtttttaatgcttcagccagtttttcacacagtgtcgtcttccgcttttggtcatcttccctttccacacccatccggaaagccggttcttcgccaagcagaattaaaatttttttgctccttgtaatcgccgtatacagcaagtttcggcgcagcatccggtaatagctgcggacaaccggcaaaattacgaccggaaactcgcttccttgcgatttatggatcgaacagcaatacgcaagcgtaatctgattgaaatctggcttcgtatacgtcacttcaatcccatcaaaagaaacgatgagcatatcttgtttttccgtattttcttttgcggtaaaaagcgagacaatctcgccgatatcgccgttatacaccccgtgttccggctggttgacaagctgcagtaccttatcgccgatccggtaaaccgcgtccccgtgcttcagctctttgcgggccccgttctcattcggattaaaaatattttgcaacaggctgttcagacggtcaatgccggccggccccctgtacatcggcgccagcacctgaatgtcttttgccgtatagcctttccgtttcgcgcttttcaccactttttccaccgcttccgccacctgcccggaagaacagcggataaacgaacggtctgcctgcatttgaaaaatattttccggaatacggccatttttaacatggtgggccagttcaataatcgaagaaccatctttctgcctgtatatgtctgtcagcctaacaaccggaatggcgttcgatttcaataaatctttcagcacctggcctggaccgacggacggcagctggtcttcatccccaaccatgatgacttggatttcatccggcagcgcctttaacagctggttcgcaagccatgtatcgaccatcgacatttcatcaatgatgacaagcttgccttctacttgccgttcctctgaatcgtccaggtcctccatgccggtcatgccgagcaggcggtggatcgtcatcgccggcagaccagttgactccgccattcttttcgcggccctccctgtcggcgccgcgagaacaatcggaaatacctcatcttttttataggtttgcgggtcaagcgagacgccgtgcaattcaccgtacagttccacaatccctttaatgaccgttgttttccctgtgccgggcccgcccgttaaaatcatcatcggactcatcagcgctttttggatggcttccttttgcgacggggcatactcgaccccgatccgttcctcaagactgcctaaagcaagcaggaattcagattccgggaactgttccgcatactcggtttgcgacataatccgctcaatattggaaacgattcctttttccgaaaaatagagggacggaagatagactttgtcttcttccatgatgactttgctctcttcctgaagtttcaccagctcattttcaatcaagtccatcgggatttcaacatgctggtattcttccaaaagggctttgacatcctgtgcaagttcttctttcaggacgtacacatgaccgtgctgcatgctttccatttccagcatgtaacagcagccggcctggatgcggtgcggatgcgtcccgctgatgccgagctgccggccgagttcatcggcccgcccgaaaccgatgcctttaatatcatcaacgagctggtatggattttgcgcaattttttcgagcgcctcatcctcgtaaacctggtaaatgcgcatcgcaatctgcggcccgaaaccgtattgcgcaagcccgatcataacacgttcaagcccctgatgttcaactaacgtatcacggatcagctgcgctttttccggtgccagtttcggtacttcgtcaagggcggcgggattttccaatattttgctgatcgcattttcaccgagcacgccaacgatccgctccgccgtttttttgccgatgccgttaaataaatcactggaaagatactcaataacgccctgctttgtattggggatgtctttttggaagcgatttgcctggaactgggggccgaatttcgggtgttcctgcatttttccaaaaaaggtgtacgtttcctgttcatggatgcgcggaaaatagccggtaatcaccgtttccttatcttccagcccggtattggtctcttccacccgcacacggatgacggaatacaaattttgctcgttatggaagatggtcgcgagatgctttccttttataaaattttcctcgtcctggaataaatccatcgcatgctgtttttccaatttcatcaccttacagcgtttcaatgtctttcagtttttcaaccattttcaagccgtatcccgaaagcagatggcccggctgaatctccaccgcttttttgaagtagccggccgctttctccaggtcgccaaggaactgcatataaatcgcgcctgtattgtataaagcatccgtatgttttgggtcctgttccagcactttttgaaattgtttcagcgcttcgtccgcgaaattggatttgataagggagagcgcgtactgaaatctcgcttccgtatccccttcatccagttcaacgctcctttgcaaatacggcatggcaaagcgcggattgccgagcatcataaaacacatgccgagcataaaatacgtatctttgtccttgagcccgagctggattgctttttcaaaacagccggcagccgcttcataatgcccctcttcgtattggattgtgccaaggctgtaaaagggggtgggaagttctttcaatgccagcgctttccggtaaaaattctgcgccttttcccgctcgcctgcagcaagcagcacatcgccgaaatggatatagccgaccggatcgtccggattgtcttcgatcacttcattaaaccatttcagcgcttcatcatatttttttttctgcaaggctttcataccgcgttcatgcttgttcatttcgtacactcctgattaatgatacgagtattataacataaaatgaatcgcttcactttttaaacgaaccccgacattttgtgagggcatgcttttgcacttcccccacccggtccagatcatcgtcttcgcaggctgtgtgaaagatgaggtgatttttacagctgtatgcaaatggagcgggtcttttcacgctgtgtgaaggagtactgccctttcctgtttcatgaaaaaacctgtactgcgatcatggcgagcttccccgtttccttgtttccggcgatcacgtttcccctggtcaacatttcactgttttgtccataaatagagccatgcccacaattgtgtgcatggctcctgtaagatcagccgacgtacatgagctgttcttcgtttttataaattttatcgatcgtggcaccgccaaggcattcttcaccgttgtaaaaaacaacagcctggccgggggtgacggcacgaaccggttcgtcgtaaatgactttgacttcatcattaccaagcagctggaccgttactttctgatccggctggcggtagcggaacttcgcggtgcaccggaatacttcaggcggctttttgcccgatacccagtttgctttcacgccggtcatatagtcggagtagagggccggatggtggaatccctgttccacataaagaacattttctttcaggtctttgccgacagcaaaccatggctcgccggaaccgccgatcccaaggccgtggcgctggccgatcgtatagtacatcaaaccttcgtgttcgcccatcactttaccgtcgagcgttttcatcagccctttttgcgcaggcagataatggcttaaaaattctttgaaattgcgttcgccgataaagcagatgccggtcgagtcttttttatttgccgtggcaagcccggcttctttcgcaatttcgcggacgcgcggtttttccagatccccgatcgggaacatcacgcgcgaaagctggtactgcccgagctggttgagaaaatacgtctggtctttatttccatccacgccccgcagcattttatattcgccgtcctggtgagtcacgcgtgcgtaatggccagtcgcaagataatcggcgccgaggtttaaagcatgttcaagaaaagccttgaacttgatttccttgttgcacattacatccgggttcggcgtccttcccgcgcggtactcatccagaaaataggtgaacactttatcccaatactgtttttcaaaattaacggcatagtacggaatgccgatctggttgcagacgcggatgacatcattgtagtcttccgttgccgtacagacgccgttttcatcggtatcatcccagtttttcataaaaatgccgatcacatcatagccctgctgtttaagcaaataggcggcaacagaagaatcaacgccgcccgacatgccaacaaccactcttgtatcttttggtgctttttgcataatgcctcctcttttctattgttgctggaacttgcggacgatttctgccgttttacgggcggctgcttccacttgctccatcgtattggcaatcccgaaactgaaacggatggaggtacggagccgttccgaatcgcgcccgaacatggcaacaaggacatgggaaggctcaatcgacccggctgtgcaggcagaaccgctcgaggccgcaatcccggcaagatccagattgacaagcatcgattccacatccgttttcggaaaacttaagttgagcacatgcggaagggccgcctccgcgttgccgttcagctgaaattccaccttttcctgctttaaaatttccataaatctttgtttaaaagcgctgtattgctttggtttatccacaagcgcctgctgcgcccatttgacggcctcggcaaaaccggcaatggacgccgtattttccgtcccggggcggcgttttaattcctgggcgccgccgaagttgcggtttttcaattttgttccgttccgaacgtataaaaatccgatcccttttggcccgccgattttatgggccgaaacggaaagcatgtccacgttcagggcatttacgtcgatcttctcatttccgtaagcctggacggcgtccgtatgaaaaacggccggatggtttttcagcagctcaccgatttcggcgattggctggatcgttccgacttcattatttccatacatcacgctgacaagaatggtatcatctcggagcgctttttgcacgtcttccgccttaatccgccctgtttcatccggctgcaaatacgtgacgtcatacccttttgtttccaggtattccagcggatgcaaaacggcatgatgttcgattgccgtggaaataatatgttttcccttttcagcggctgcttctgccgtaccgagaatcgcgtaattatccgcttcggttccgccgcttgtaaaaatgatttcattaaactgtgcgccgatgctgtctgcaatcacctggcgcgcttcgtccaaaatgcggcgcgcttccctgccgaatgcatgaatgctcgacggattcccgaaatggccggtaagcacttgcatcattttttctgcaacttgcggaagaacaggggaagtggccgcatggtccaaataaattttttccacttttcgcacctcttaattagatataatacatgtaggcatccggttctgtatcttcccggtatttggccagatcttcaatggttgtgctgtcaagaacgtccttgaccgcgtcccggatccggatccagagctggcgtttcaccggttcttcgtcttcaatgccctctaccggtgtaatcggtccctccagcacacggatcacatcaccggctgtgatttgcgaaggttttcgcgttaaaacatagccgccgtaagcgccgcggatgcttttgacaaacccggcattacggagcggagaaatcagctgctccagataatgttcagacaaattctggctctgggcaatggatttcagggaagtcggccccatgccgtaccgctttgccagttcaatcataatggtcagcccatagcggcccttcgttgagattttcatttcattccacctctttccgattattcccgaaaaaaattgttaagccaaaaacggcagatgagcgcgtaaaaaaataagcccattcatataaatgaacgaacagactggtcccaaacttaacatattatagcatatttatcggcataatgcgaaacaagagcggcgtgtgaatgctgctttaacttgaaaaacatcattgaaaacaggaaaaagccccctttaattcattagaggctatagagggtgttttgctatgttcaattaaggcgaatttttgcgtttttttcacaagttccataataaaatcatcttttaatctttggttttgtcatatttggaaatacttcgttttctatctgacttgacttggtgtttcaatgcatttttatgcgctttcatggcggaagaatgattaacagaagaggattcgattgtgtcacttgtgtccgtatcgtcgtttcctgaaacctctgtatttgagttgggaccagaaacaagtaaagaaccatcatcttgtgcgtatgctaaaaatacataagattggccaacttcaggaagcacatcatcatcaaatgttacgattgaactcccgtcttccgaaatgccgccagctttttgaacgggaataggtttgtcagtctctagttcaccttttatattttccaatactgttattttgtaattggtatagggtgtggaaatttccttcgtaccctcttctgtttcaatttgtgttgtatttttatatgccgtacctgttttctcctcaacgcatgctaaaaatcggcgtccccgacagtttcttcaggatgatccctattaattgaaaaagcaccgtccatctgcacttttttaggatgtttgctcgttttattggttgcagcatgatgagagcacgcccccatcgccattgcagcaatcagtaccagaacaaccaccaatggaagcaatgtttttttctgtgaaaaactcattctaaatccctcctttgattttaggttcttttagccgacaaggtttgaatgcgttttcattatcgtttaatgttattctgatggtttcgtatttatacatcatgtcactgctcgtatgatgtttcaagcctaaagcatgtccaagttcatgggtcccgacattttgcctttctgataaataccatcaggcgacaatcattatggattaagacaatttgaagggggcctggttctttcaaaaatcaacttcatccgaaaaaacaccatccggttttccccggatggtgttttttattgtgccgtataacccccgtccacatggagatccgtgccggtaataaacgatgcgtcatcgcttacaaggaacaaaacggctttcgccacttcttccggcttgccaagtcttttcatcggattgtggtcaatggtttcctgaatttgttcttttgtgaaatatttcagtgccggcgattctgttgtacccggagaaacgctgttgacgcggatgccctgtttggcatacgtaacagcttccgcccgcgtcaaattcacaaccgcagctttggcggcggaataggccgcactgttggtaatcccgacgtgggccataaaagagcccatgttgacaatcgcgccttttccgtttttcagcatgtacgggatcgcatatttattggaaagcatgacaccggttaagttaatgtccaatactttttgccagtagtcctggtcgagttcatgaacaggcccgtgcttttccggaatcccggcacacgcaaccagaatgtcaagcttcccgtaagtatccgtcgccttctccattaaatgcctgacactgtaataatcggaaacatcacaatgaacaaaaagcgcttccccaccggtttctttgattttgtcggcaatttccatcttggattccgccacatccccgatgacgactttcgcaccctcgttcgcaaaaagccaggccgtcgcttccccgattccggaagcgccgcctgtaatgacggcaactttatttttcagtctcaccgcgttcaccttcctatgtcaaatcatacaaaaaccatgcacagccggatctcatttttttccgcagccgtttatggcgcccattttcctagcctacaatcattatatcaaaaaagcaacaatgtacagccgggaaaactgaaaaatacaaaaagcccccatcaatgctattccctttaaacctatgcccgaaaaacctgattgcttcccgcatgcccgtgaaatctgttaagataaggatacgaaaacaggtttggagcgattaaaatgaaagacgaaccgcttgcctaccggatgcggccgcgcacgattgatgaagtgatcggacaggagcatctcgtcggcaaaaataaaattatataccggatggtcaaagcgcgccagctttcttccatgattttgtacgggccgccgggcgttgggaaaacgtcgattgccagcgcgattgcgggaagcaccaaatatgcattccgtacgttaaatgccgtgacgaacaataaaaaggatatggagattgtcgccgccgaagcaaaaatgagcggaaaagtcattttgcttctcgatgaagtccaccggctcgacaaagcaaaacaggattttttgctgccgtatcttgagtccggcatgatcgtcctgatcggggccacaacgagcaacccgtaccatgccattaacccggcgatccggagccgctgccagatttttgagcttttcccattatcgcttgatgagatcaagacggcgcttacccgtgcccttgatgatgcggacaggggccttggcaaatacaaagtgaaaatagaggaagcggctttcaaccattttgcgcaaggatcgaacggcgatgtgcgtagcgcgttaaatgcgctggagctggccgtgatttcaagcgaacctgatgatgacggcgtgatccacattacgctttctattgccgaagaatgcctgcagaaaaaaagccttgcccatgataaggacggcgacgcgcactacgatgtgctgagcgcttttcaaaaatcgatccgcggcagcgatgccaatgccgccctccattatttgggccggctgatcgaagccggggacttgccgagcattgcgcgcagactccttgtgattgcttacgaagacatcggccttgcaagcccgcaggccggcgcgcgcacccttgccgccatcgaagcggcagaaaggctcgggtttccggaagcgcgcatcccgcttgcagctgcggtcatcgaattatgcctgtcgccgaaatcaaattccgcgatcatggcgattgatgccgccctttctgatatccgtgccggaaaaagcggcgaagtgcccgcccatctgaaagacgcccattataaaagcgcaaaacagctgggacggggcatcggttacaaatacccgcatgactttgaaaatggctgggtcaaacagcaatatcttccggacaccctcaaatatgcccgttattatgacccgaaaaaaacgggcaaatttgaacgggcgcttgcccaagtgtatgaaaaaatggagcagaaccataagccgtaaaaaaagaaagcatccgtgatgctttctttttttcaatgttcatcttttaccctttttaccgggatgtctttcaaaatgtcacggacaacgaaactcgccataaacagccctgcggttgacggaacaaacgcattggatgaaggtggcatttgtgctttacggatttcggcttcatcatttccgaccactttgcggacatcttcgcggatgacgatcgggctttcgtcggaaaacacgaccggaatgccttttttgatgccttcttttcgcagcttcaggcgcacaacgcgggcaatcggatcggtgtgcgtttcggaaatgtctgcgatgcggaggcgtgtcgggtccattttattggccgcccccatgctggatatcattttgatcttccgtttcaggcattctttcattacatgcactttgtaaataatcgtatcacttgcatccaccacatagtccggcttataagagaaaaactgttcagccgtttcttccgtatagaacatttttaaagaaatcacgtcacaatccggattgatatcggcaatccgttttttcatcaaatcggctttcgcctgcccaacggtggaaagcagcgccggaatctggcggttaatatttgtaatgtcaacatcatctttgtcaacaaggattaaccttccgattgccgaccgagccaaagcttcaaccgcaaacgagcccacgccgccgacaccgagaatagcaacggtgctgtttttcagcttttgcagcccttcctgcccgattgccaattcattccgtgaaaactgatgcagcaatttcctcatctccaaacatactcatttctttcctagattatccaaaaacggcccggaaagcaaacctttatgttcagctgcttgccgccggcttttccgtttttttatccctgtatacgctcgaaagcaatgttccgaaaaaagaggccagcacctgctgaaaaagcatgccggagatgaccggcagcacaacctgggccgggaaaaaggtgactgcgatgacagatccggcactgatattgcgcatgccgccgctgtatgttaaggtcacgatcatgccgcggtcaagatggaacaaagcgccgatcagccagcttaataaatagccgcaagccgaaatgaacagcacagtcaggataataaacagcacatgggcatccattcccctgaggtacggcgatacgaccccgccgttgatcatgacgacaagaaacatgccgattttggaaaacggagaaagtactgaagaagccttccgctgggtttcgagctgtgtaaactggctgaacaggatgccgagcaaagacgggatgacgatcatcgtaaaaagatcttgcatgagcggccaaacctcaatatgtacattcttaccgacaaacaagagcaaagtaagcggcacaacaaccggagaaagcagggtatctatcaaaatgaccgttaaaacaagcgggatattccctttttgcatcatgacccatacaaagcttgtcacacctgtcggaatggcggccgaaagcaaaaacccggttgtcgtcagcgggtgcccgggaaagagcaaatgccccgttccgtacgcaaacaagggcataaaaaggtgtagcacccctaaagcaagcaaaaccggaaacggatggcgaacaaccgccccgagctgcttaaaggttgagccgatgctccctgtaaaagtcataaaagcaaacagccacggcactaaaaataaaaggcccgtcaaccggtgcccgagcaccatcccgatgatcaagcttcccgggataaaaaccggcatcattttgccaaggaaacggtttgcgcgatcaaaaaacgaaaaacacacaaaaattccttcttttccaaaaaataaaaaccctctttttctaaagagggaaaggagtggaatgagccccggacgtgccgttcttgcaatcctctgttttgatcccgctctcgagcaggtgggtgccctgcaccaggctttatgcgtccccgcaaagggcatgcacgccgtctggtgaccccgggcccccgataatgaagtgttcggtcaaaacgataggaacatatacgaacaccccaggactcattcaacttgtttatatcatagcatttttttcacccgttttcaaacgaaaaaaggctcgcaggcggctggaaaaattttacgccgcctttttccgggttttgatctcatttttttgcttttaatttcaattgcagctcatccagctgcgcctcgctgaccgcgcccggtgcattcgtcagcaggcagctggcgctggctgtcttcggaaatgcaatcgtgtcgcgcaagttgctgcggccggcaaggagcatgacaatccggtcaaggccgagtgcgatgcccccgtgcggcggcgtgccataatcaaacgcttcaagcaaaaagccgaactgggactgtgcctgctcttttgaaaagccgagcgccttaaacattttttcctggacatcccgtttataaatccggagcgatccgccgccgagttcatacccgttcaatacaatatcataggcctgcgcctttacgcttgccgggtcggtttccagcttctcaatatcttcttcaaacggcatcgtgaacggatgatgtgccgccgtataacgccctgcatcttcgtcatattccaaaagcggccagtccgtcacccacaggaagttgaatttcgactcgtcaatcaggccgagttctttgccgagcttgtttcttagcgccccgagcgcatcggcgacgactgattttttatccgccacaaacaacagcaaatcgcccgtttctgcatttgtagcagccgctaattgcgattgttccgcttctgtaaaaaattttgcgatcgggccctttaacccttcgttttccgctttcagccaggcaaggcctttcgcgccgtaacgtgcggcaaattcgccgagcgcgtcgatgtcttttctcgaatatttgcttgccgcgccctttgcattgatcgcttttacttgcccgcccgaggtaacggcagatgcgaacactttaaaaccggcgttttggacgatttcggagacgtccaccagttccatgccaaagcgggtgtccggtttatccgatccgtaccggttcacggcttcctcgtaggtcagcctcggcagcggcgtttcgatatcgatgtttttcacttctttcatcagccgtttgatcattttttctgtcatggtcaaaatgtcttcctggctcatgaaactcgtttcaatatcaatttgcgtaaattccggctgcctgtctgcacgcaagtcttcatcacggaaacagcgagcaatctggtaatagcggtcaaaaccggagatcatcaaaagctgcttaaacaattgcggcgactgcggcaaggcgtaaaattcgccaggatgcacccggctcggcacgagataatcgcgggcgccttccggggtgctttttgtcaaaaccggggtttcaacatcgataaacccttcttcatcgagaaagcctctaattgattttgtaatcgcatggcgcattttcatcgtttcaaacatgaccgggcgccgcaagtcgaggtaacggtatttcaggcgcacatcttccgccacgcccgtctcgttttcaatcataaacggcggggtttttgcattgttgatgatcgcaaggcggtcggcctgaatttcaattttgcccgtttttaagttcggatttaccgtattttcggaacgggcgatgactttcccctctacttcgagcacatactcgttccggactttttccgcaagtttaaaagcttcttcagagaccgccgtattaaatacaatttggacgataccggcacggtcgcgcaaatcgatgaaaatgaggccgcccaagtcgcgccttctctgcacccatcctttcagcaccactttttcgccaatctgttgttccgtcacatcaccgcaatagtaagaacgtccttccatcatgcttcccccctgtttgccatatctttaaaagctgtaataaacccttcaagcggcagttctttttgttcgcctgtcgccatatttctgacgcttgctttcccggcccgcagctcctcttcgccgatgaccgcaacaaatgcggctttcacccggtccgccgctttaaactgtgccttcactttgcgtcccaaataatcctggtcagctgagaatccggcacttcttaatgcctggagcaatttaaaagcagccggtttcgtctcctcgccgatcgcgaccacatagcagtccgtcctgtggccaacaggaagttcgatgccttccgcgtccagtgccgcaagcagccgttcaatgcttaaggcaaacccgatccccggcgtttccggcccgcccatttcctcaacaaggccgttgtaacgcccgccgccgcaaagggtggtgatcgcgccgaatccctccgcattgctcataatttcaaaacaagtatgcacatagtaatcaaggccgcgcacaagcccggggtcgatttcataagggatgccgagcgtgccaagaaactgcaaaactttatcaaaataagcttttgatgcatcatttaaataatccaaaatggatggcgctgttttcatgagcggatggtcatgatcttttttgcagtcaagaatacgcagcggattttgttcaaggcgtttttggcagtccgcgcaaaactccccgatatgcggtttgaaatgatcaataagcgcttcccggtgcctgagccggctttctttatcgccgaggctgttgatcacaagtttgacattttttaaaccaagctgtttgtaaatatccattgcgagcgcaatgacttcggcatcgatggccgggtcttcgcttccgagcgcttcaacgccgaactggacaaactgacggaagcgccctgcttgcggccgttcataacggaacatcgggccgttataatacagtttgaccggctgaaccgtgtttccgaacattttatgcccgataaaggaacggacgaccggcgctgttccctccggccgcagtgtcaggctgcgcccgcccctgtcatcgaatgtgtacatctctttttggacaatatccgtcgtgtccccgacccctttttggaaaagctcggtatattcgaaaatcggtgtccggatttcccggtactgatagttttcacatattttttttgcggtgttctcaatataattccatttttccacctcgccgggcaggatgtcctgcgtgccgcgcggaatttgaacggtcatgctgtactcctccttctattgctaaaaaatgatgggtttccctcttcattctaatatgaaaacgagtatcctccttcccagtcaatgtttatgtaaaataaaaaacccccggtcccttgtcttataaacaagggacgagagttgaattcccgtggtgccaccctaattgaagcgtctgcttccacttttacagttaacgcctgtaacgcccgtccctactggatttccgttcaggacagaacctacaaagtgttcgttcattaagccgttgtgcagaaatgttttcagcccgggacatttcctctcttttcacacggatcttaattactcttctttgtcatcggttttgccaattttaccatctatttttattatgttacgcgtggcaccggctgttgtcaaggctgccggcaaagtttttccccgatctgcgttcagcgcctgaaaaagttcgttttccgcggatcgggtctttcattatgagcgccccagtttctttttcaaaagtttcaggtccccttttgaaagttcagtttcaatcgctgattcagcgttgaacgcttcctgtccggcacttcccggatcctggaaattaacgccgtaaatttgattaaatgcattaccggctgtcctatttttatccgctgctctcaatgccgttcactccttctcgttccatcctttctatttttcccttttttattttttcttacccgcaaaaaggagtttttttacggagcgcgaataacaaatagtggacaattttccggacagggatgaggggtggagatgtgaaaaaactttttttccggctgtttttcctggtgctcttttttctgattgcacccggcgtgatccatgcgggggcggaagaggccgggacggtaacggtgacgcatgcggctgtctacatccgcagcgggcccggggtgtcctacccgatcgcaggcaaagcagccaaaaacgacacgtacacggttcttcaaaaagacggggattggtttcaaatccgcctcccgcaaggaaatacaggctggattgcgggctggcttgtggaaacaggcaccccttccgcaaaacaatcaaaacaaggaaaaatcaccgctgaccgcctgcgcattagaaaagcgccggaccagtctgccgcaatcgttggcacgcttgaaaaaaatgccgtagtcacggttaccagggcagaaggcggctgggtttatattgaaagcggcaatgtttcaggctgggcagacagccagtatgtacagacggaaaaaaacaaaaacgccgggaaaacggcggaaaacaacgtaagcgccgcaattgttgccgccacaagcctgaatatccgccggtctccttcgcttcaaagcggaacggtagcgacagtaacgtacgggacgagacttgaaattaccggaaccgaccacggctggtatgaagtggaactggaagacggcacgcacggatgggtcgcaggcttctatgtgacgcgcgaaagccaggcaaagcgcagcagtgaagcagaagtgaccctccattccggcacaaacctttacaaaaggccccaatccggctcggacacggtgggaaccgccaaggccggagaccggtttcccatcgtttcagaaatggacggctggtataaaatcaggctggaaagcggcacttcagcctatatttcggcaaaagccgcccaaaaaagtgatacggctgtaaaaaaaggaatcaagggaaagacgattgtgcttgaccccggtcacggcggaacggataatggcacaaccggcgcttacggcacgctcgaaaaactggtgacgttaaaaacggcgaatgccctgtacgaaaagctgaaaaaagcgggcgcccgggtcattttaacccggaacagcgatacgtacgtatctttgtcggaaagaaccgccatcagcaatacaaatcatgtcgatgcttttgtcagcattcattttgacagcgctgaagattcccatacgcgcgggcatacgacgtattattatcatgcgcaggactatgatttcgcaaggcttgtcaataaccagatcacaagccggctcggcaccgttgacaggggcgtaaaattcggggatttccatgttatccgtgaaaatacccagcctgccattttgcttgaactcggttatttgagcagtccggctgaagaaaagcatatcgtggagaagtcttttcaaacgaaggcagtggccggcatttataacgggttaaaagcttattttcagtaagaaaatgccggggcatccccggcatttttttatttcttaatatttggctgcggcattgcgcgtttgataaagaacgacaaaattaacgcaaacgctgcgatcccggtcgcgacgaaaaaggcatcgtttatgccgctgatcgtcgcattcacaaccgatttttgatacacaatagaggagccgagcacctgcccgtactgggaaggcagcccggaagcatgggccaggccctgcccgatggccgcgattttagcagacacatacgggttgatatttgcataggcattgacgtagtttgccgtatggaaatcggcacgggtggacatgacggttacgagaaatgccgttccgagacttccggcaaccgtacgggcggtgttggccgcagccgtcccgtggctggtcatatgaatcggcagctggttcatcccttcggtcatgatcgtcatcataatgaaagacatcccgaagctgcgcaaaacatacaagaataacaagtggccgtaggaggtcgtcatcgacagcttcgtaaattcgtaagttgtccagacggtgataatcaagccgaagacagcgagcggtcttgcccccaacttgtcaaacagccagccggatatcggcgacataatccccatgacgatcgcccccggcagcatcagcaaaccggaatcaagcgcagtaaacccgcggatgttttgcaaataaatcggcagcaaaatcatcccggcaaacatcgccatattcactaccatgctgacaatcgtcgttaaagcaaagatatcatatttgaatacacgcaaatcaagcatcggtttttccgtcgttaattctcgccatacgaacaaaacaagcgagataacggcaatgatcagggaaatgacaacttgtttgctgctccagccgtcattcccggcttcactgaatccgtacagcaaaaagccgaaaccgagcgtggagaagataatacccggaatatcgattttcgggtttgtcgttttcatgacatctttcatccatgccaaagtgacaaaaatatcaatcacgccgaacggaatgacaatccagaacagaatatgccagtcgtaatggccgaccagccaccctgacaatgtcgggccgatcgccggggcgaaaatcatggcaacccccatcattcccatcgcgctgccgcgtttttctggcgggaagatggttaagaacaccgtcatcatcaacggcatgatgatcccggcaccggaagcctggacaatgcgcccgagcatcagaatcgagaagtttgtcgaaatggcgcacaaaaccgatccggccgtaaagagggaaacggctgtaatcagcattttccgcgtgccccatttactgatcataaatgccgtaaccggaacaagaatcccgtttacaagcatatatccggttgacagccattgcaccgtattcgccgtcacattcaagtcgttcataatatgcggaatggcgacattcaaaagtgtttggttcaaaatcgccacaaatgccccgagcatcatcgcaaaaacaattttccccctgccgtgttcttcctccacttccgggggaacggcagctcgcccgggtgcttcagccggacgtttttcgtcgtccgtacgagcgcggcgcgtttccattttttcaggctctgccgccaatccttcatctgtttttgccggcacctgcgtttccgctttttcaggcggcgcaggcattgtttccatttccggcgcccgcttgtcaagaagcgggctttccatctttttctttcttcccctgttccttaatatgagattcaggataagaaggacaatgaccgataaaagaacataacctgcgataaattttcccatcggattcacctacttatgaatgcgcacagtcacgttcatgcccggaaccaggtccagcccgccatagctgtcaagtttgactttaacaggaatgacctgtgtttctttcgtataattgcctgagcttctgtctgtcggcataagagagaacgtgctggcagccgcttttccgattgaatcgacggttcctgtcagtttggtgttcggataggcatccacatacacgtcaacgtcctggccggttttcacgtcattaagatctgtttcttttacttcagcagtgacatacaagtggtccaaatcatagctttgtgcaagtgttgtaccggctgccacatacgtatttgcaaccgcggaatttttcacgatcgtgccgtctgccggcgctttaatatccattttcaccgtattggcgccgttttgtacttcaacggtaccgactttatcccctttggtaaatgtcttgccttccttaccgtcccatgaaacgagtttgccggttgcaggggaagcgatggtgaccgactggccgtcaatataggcgttatcggttgtgacatagctgaccgagcggttgtaaaaataatatccggtaaaaccgccgccaacgagaataacaagaataataatattgatcaaaatcatccgtcttgcgctcataaaaagtttactcctcctcagatgttaaaatttccagcatttcgttgtggagccttaatagattttccaactccgctccgtaacgttctgtgattaggtacattttttgtttcagtactgtattgccgcccatgaacgctttgagcctgcttttccccttttcggtcagacagaggacaacggctctccggtcctccttggatgataccctgttgacaaattcctgctggacaagccggtcaacaatgccgctaactgtgctgttcgttaaatagaggctttccgccagctcatttaatcgcatattgggatgaagcgcaatggcttttagcgcaaacatttgcatcgcggtcaagccatgctgttccgcctctttttcggccaaacttaaaatggctttattcagcctgaaaagcgattgtaacaattcatatgaactgttgtccatgtatcccccttcctttatcccttaaatgattctttgcgaaataattcgcatccgaatgattaacgctatctatctttgcatatccaaagtacaattgtcaactatattacactaaaacttttttggaaacgtttttgcttttcaaaaagaaaaaaccccgaatgatcagggttttggctgtttatttgctttccaaaatgagcgtaaccggcccgtcgtttgtcagccggacatccatcatctccccgaatctgccggtttcgacatggacccccttttcttccagcttctgattaaacagatggtaaagctgttctgcctgtccgggctttgccgccgccataaaattcgggcgccgccctttccggcaatcgccgtacaaagtaaactgggaaaccgacaagatttcccctccggtatccaaaagcgacaagttcatttttccctgttcatcttcaaacacgcggagatggacgattttttcggcgagatagactgcatctttttcggtatcttcgtgcgttacgccgacgaggaggacaaagccttttgtaatgcttcctgccacttccccgtcaacagtgacgcacgcttccttactgcgctgcaaaacaacccgcatttttctgactcctttaactcatgatccttctgactgaataaatatccggaatatgtttaattctttccacgacccggtgcaaatggctaatgttctgaatggaaatcgacatgataatcgtggccattttgttgcggtcactgcgcccgctaacggccgaaatattcgttttcgtttcattgaccacctgcagaacttcattgagcaagccgcggcggtcgtatccggtaatctcaatgtcgacattatactctttccggtcggccgcatccgtctcccattcgaccgggataagccggttttgcgcctcttcgttctgcacgttcgggcagtcagcacggtggacagaaacgcctctgcctttcgtgataaagccgacaatttcatcgcccggcaccgggttgcaacatttcgaaaggcggatcagcaaattgtcgacgcccttcacggttacgcctgcatcctttttccggtgctttgcggccggtttctgttcggagacaatctccttaatcgcttcttcggagtcccgctgcttccgccatttttctgtcagccggttggcgatttggcttgcggtaatcccgttgtacccgacagcagcgtacatgtcgtcttcattggcaaaattaaatttttcggcaactcgtttgatattgtcggcggtcatcacttcttttacgtcgaattccatcgcccggatttctttttccaccatttcgcggcctttttcaatattttcttctttccgctggcgtttgaaaaactggcggattttgtttttcgcctgcgatgtctgggcaaggttcacccagtcgaggctcggcccgtatgagtgttttgaagtgagaatttcgacaatatcgccagtttttaactggtaatcgagcgtcaccattttgccgttgactttcgcgccgattgtcttgttgccgatttccgagtggatccggtaggcaaaatcaatcgggacggacccggacggcagttcaatgacgtccccctttggcgtaaagacaaacaccatatcggaaaacaggtcgattttcagtgattccatgaattcttccgcattattggtgtcattttgaaattcgagaatttcgcggaaccatgacaattttttctcaaaagacgttttctcattgaccgttttgccttctttatatgcccagtgtgcagcaaccccgtattcggcaatgcggtgcatttcaaacgtccggatctgcacttcaagcggttcaccttttggcccgatcaccgtcgtatggagcgactggtacatgttcggctttggcatcgcaatatagtctttaaaccggcccggcatcggtttccagcatgtatggatgacaccgagcacggcatagcagtctttgatgcttttgacaataatccttacggcaagcaagtcataaatttcgttaaattgcttatgctgctggaccattttccggtaaatcgagtaaatatgcttcggtctgccggaaatttctgatttgatatggatatccgcaagccgttccttcacttcttcaatgacattttgcaggtactgttcacgctcggcgcgcttccgcttcatcaaattcacaatccggtaatattgctggggatttaaataacggagcgaggtgtcctcaagctcccatttgatggcggaaatgccgaggcggtgggcgagcggcgcaaaaatttcgagcgtttcattcgcgatccgccgctgcttttcggggggaagatgtttcaatgtacgcatattgtgcagccggtccgcgagtttgatcaaaatgacgcggatatcctgcgccatcgcgacaaacattttccggtggttttccgcctgctgctcttcatgcgatttatacttaattttcccgagtttcgtcaccccgtcaacaagcatcgccacttcatcgttaaattcttcacgaagctcgtcaagtgtcacatctgtatcttccacaacgtcatgcagaaaacctgctgcaaccgttgaaggatccatctccaaatccgccagtatcccggcaacctgaatcgggtgaatgatatacggctcccccgatttgcgcttctggccttcatgcgctttactggcgaacgcacaggcatgccgcaccatttcaacatgttcgtcgtttaaatattgttttgtcctctcaatgacgtcctcggcggtcattattcggtcattcgccataaaaaaatcacctttaaactggaatatatgaattgatgattgcaatatcatattgacattattatcatgaaaaaaaagaagattgtaaagtaaatgacacagaatggaagaaatttggcgaaaacagccggtttttcccagtacggacaaaaccggcccgtcatttcatccggatgaaggataaataaagaaaccgacaattttgccgatttccttacaatttattcattctcgtattccatcagggtgaggatatcatagcccttcagtttatcgcgcccgtgcaaataattcaattcaattaaaaaagcaaggccggctacaaccccgcccagttcttcaacgagccggacggttgcttccatcgtgccgcctgttgccaaaagatcgtccgtaaccaaaacgcgctggcccggcctgatcgcatctttatggatcgtgagcaccgcttttccgtattcgagatcatattccgcacggatcgtttcccgcggcagtttgccttctttgcggaccggggcaaagccgacgccaagttcgtatgcgaccgggcagccgataataaagccgcgcgcttcagggccgacgacgagatcaatctgtttgtctttcgcatactggacgatctggtccgtcgcatatttaaacgcctctccatcattcatcaaaggcgtcacatccttaaacatcacgccttttttgggccagtccggaacgagtgcaatatattgttttaaatccattttgctgtttcctcctcatactgtacagcaggcttgatcatttggtcaaaccacatcttcagctcatggaaagatgagtacagcaggtccttttccatttgatattgtgccagttttttctgatacgtaaaagattcctttaaatcgcgtttttgtttggctgctttcagggaaataaatccatcctttattgtaacaaaatcaagttcaaaaaacacctgcgaaataaaatcgatcgtacttctcgaccagccgcggtaagccgccagctcatccccgtgccgcttcaggttgaacgttttcctttttgcaagaaaagcgtaaaaccatttaaaatgttcgcgcgtcggaaacgtgctgaaaaagtggttcccggcatggtaaaaatacgcataaatcctggccggcgcaccgccttcaagcagtgccgccatcatcttcgggcctggcggaagatcaagaaacacaatatttttatttgccgggtcaaatgcccttgcctcttccattgtcgccaccggcacaaggcggacggaaaaatccggcagcggcagtttccgcaatgtttctttttggaacacaacaaaagcctggccatcttccgggacgtgcccgacccattgctttaaaggcctgttgcccctgaaatcaaacaattgccagtttgtgattttgatgtcctttaccatcatttgcggcttgcggatattattccattcattgatggacagttccccgacaaccgatatgcaggcagaaggggaaatatgcggggcaagatgcccgagcccgaagccgatcccatcgagcgttgtgccgtttttagaaagcgtcaatttcaaatgtttcccgtctgcgccgatcgcccggatttgcgggcaataggccccatccagcaacagaagcggcttcggattcgccgtgccaaacggcgagagcaatgccatttcgcggatcgcttccatccctgcttcttctatggaaatttcagcgctgatgttcgtaaccggcacaaacatctcatccggcaatgccgcggcctgttcgttcagccggcgccgcagttcctccacatcggataaagaaagcgtcatccccgccgccatcggatgcccgccaaaatgcggcaaaatatccctgcatttcgataattcgttaaacatatggaagccgtcaatgctgcgcgccgatccttttgccagccctgtttccgggtcaaagctgagcacaatcgcaggccggtaaaagcgttctgtaaggcgcgaggcggcaatgccgattacgccggcattccagccttctttcccgacaacaaggacacgcgcccccttttccacttcttcttccaccagttcgattgcttcatttgtcatgtcgtttacgattttttgccgttctttattgagcccgtcaatcgtttcagcgagcatcccggcttcttctgtgtcttcggtcattagcagttccgctgccggtgccgcatgctgcaggcgcccggctgcatttaagcggggggcgagcacaaagccgatggtttcttcattgatctcttcctggcggatatccgcacaccggcacagcgccacaagccccgcccgctttgtcgttctcaaccgtttgatgccgtttatggcaatcagccggttttcgtccagaagcggcacaagatccgcgaccgtcccgatagcggccaaatcttcaagctgttccggcactttgccgtacagcgcatgggcgactttaaaagcgacgcctgcgcccgacagttcccggaacgggtatgtactttccggatgcttcggatggacgatggcaaaggcttccggcaataccggcccaggttcgtgatggtccgtaataatgagcgtgatcccgagttcgcgggccacttccgcttcgtggacagcggcaataccggtatcaacggtaatgattagctgaaaaccctcttcagccgcccggcggaaagccgcttcatttggcccatacccttctttaaaccggtccgggatataaaattcagcatgggcgccaagatcgtttaaagcggccatcatgatggcagtactcgttacgccgtccgcatcgtaatcgccgaagacgagaaccggttcttcttttttaatcgcttcgcggatgcgggccgctgctttttccatatcatgcagcaaaaacggatcataatacgctagcccttcatggaataaaaaagaccgcgcttcttcaacatccgttatgccgcggtttacaagcaattttgaaacaagtggcgaaacgttcaattgttgcgagatcgttgcggctgcttttggttccatttccggcacccgccatcttgttcttgactgcagcatatctccacctctttcacaatactttattataacgtttcggcggaaaactgtcattacaaaaaatgcaggcatttcgcctgcatttttcttatacttgcggttcatccgcgcgggtacgccgcgctttttgaatgacgatggcgccatgttttttcagctgccgttttttcagtacaaaccagatttgtgcggcaatgaaaatagacgagtatgttccggtaatcaacccgacaatcagcgcgatcgagaaattgcggatcgattcactgccgaaaatggccagggccacggacgtcatcagcacggtcaaaacggtattgaccgaccgggccagtgtctggcggatcccggcgttgacaatatcatgaatttccttcgcggttttaattttccgccgccggtttaaattgtcgcggatccggtcgaatgtgacaatcgagtcgttgatggaataaccgacaatcgtcaggaccgccgcaatgaaggtgacatcgacctcaagccttgtgatgctgaaaaaggcgatcatgaaaaaggcgtcatggaagagtgcgacgatggaggcaacccccattctccattcaaaccggaaggccacgtaaataatgatgccgactgccgccaacagcaaagaatacacggcgcttaaggccaactctttcccgactgtcggcgaaacggagctgatgctcgggctcttcccgtatttttctgtaaaatactggttgatttgcgtgctcttctctttatcgctgaacgagcctttcacccggatcacggcatgatgccggttggtcccctgcatcacaatatcttctgatttcaaatgcagatggtcaaggtcgcgctgaatctcctgctggctgagtgcttgatttgaactgacttcaatgcgcgtcccgctcgaaaaatcaatgctcagattcaatttgaaaatagacaggagaataaacccgccaatgatcagcacagctgaaatcgtaaagaaaatgttgcggtgcttgacaaagtcgtaccagtcaaatttcgttttcaaatcatgcgtatcaatgttttcagcaatattgtggatcgccgattttttcacgccgaaccagtgcggccgctttttcaggaaattgctgttcacccagaggccgagcagccatctcgagccgtaaaccgccgtcaggaagctgagcagaatactgataatcaaagttgttgcaaagcctctgatcgagcttgtcccgaaataaaagaggatgaccgccgcaagaatcgtcgttaagttggaatcaaaaatggccacgaacgatgacttgttccctgcccggaacgcggatttcacgctttttccgacgcgcagttcctctttaatccgctcgtaggtaataatattggcatcgaccgccatcccgaccccgagaacaagcgcagcaatcccgggaagcgtcagaaccgcgcccattaaacggtaaatgagcaaaatcaggaaaatgtaaacggacagcgtaatacatgcgataaaaccaggaaaacggtagtagccgatcataaagagaaaaatggctgcaacgccgataatcccggcaagaatcgtgtcatgcagcgcttcctgtccgaaagatgcgccgacagaggtcgaatagatttcgtgcagcttcaccggaagcgctcctgcattcaagaggtctgcaagattggacgcttcttttaccgtaaagttcccggtaatttcaacctggtctgtgtttaaaacagaattcacactcggattggacaaaaattttggattcttcttcgccacttcttttttataggaatcgcccttttgaaagtccatccagatgacaagctggttattcggtgccatcgccagaatttttttcgtgacgtcggcaaactttttccggctctttaactgcaggacaacatccggtttgccgttctggtcaaatgactgtttcgcttttccctgcacaaggtctgtcccgtccatcatcactttgtcattgacgtcacggaatgtcagattggcagttgtcgaaagcatctttctcgcttcgttctggtctttcacgccggcaagctggacgcggatccggttattgccttcgaccgagatctgcggttcgctgacgccaagcgcattgatccgccggtccaatgcggcagccgtatccgcaagcgcggctttatcgatcttctgcccttttttggccggttccactttgtaaagcacttcaaacccgccccgtaaatcaaggccaaggttaatttttttgacaattttatccgtcgttccccctattaatcccgcaaacagcaggacaatgagaaagaaggcaacgatgcggctccttttcaccattatgtacagcctcctagcgaatcaaaacatatcacatgccaaaaaatacatgcgcccgtgaatcatttctattatgatgcagggcaaaaagcgtgtcaatttttcttattattccgcatgcagccgtttttgcttatttgcccgcttattcttccgtcttgtccccgttaaaaagcgcatccagctccttttcgtccagctcggcaaaccagtttggcgaacggtaagcttccacggttttaaaactcatcaaatcgccgggcttaaccgataaaacgtcggaaacaagcgcatacatacggacatgcgccggatccggatttttccacactttccggattaaatattcccagacatccctcgcttcaatcgcgccgtagccaaagacggccagttcttccgccttgctttttacggcaggttcaagttttttatagtatttttcataaggatggcggtccttcacacgctctgcccctttccttaggcattgatgtattcttgtccattaccgtgcatatacatcattgtataggaaaattgcggatttgagaaggcaggttaacagaatgtccaagtttttaaggggaacgattatattgctcgccgcaggctttgtaacaagggtgcttggttttatcaaccggattgtcattgcccggtcgctcggggaaacgggtgtcgggctccatcagatggcttttccgaccttaatgctcgtcattacggtaacccagctcggactgccggtcgcgatctcgaaatgtattgccgaagcagacgccgtcggggacagggcgaaaattaaaaaaattcttgtcatctccctaacggttaccatttcgctatcggccatttttacgcccgggctgattttactcgcgccgtatctggctgatcatttattcacagatccgcgcgtctattacccgcttgccgccatcacgccgattatcccgattgtggcggtttccgctgtattgcgcggctatttccaggggaagcaaaacatgaagccttatgccgtctcgcaggtcatcgagcaaagtgtgcggattatgctgatcgcattttttgccaatttgcttctgccgtacgggattgaatatgcggcagcaggggtgatgtttgcatcgatattgggagaactgtcatcccttctttatatgtttacgatgtttaaactgaaaaagcagattcgcgtccgcaaacattttttcaaagccgtaaaatcggggaaagacacgttttacgaactgatgcgcgtggcggttccgaccgtctggagccggctgatcggcaatctctcctggttcctcgagccgattgtcgtctcccactgccttgctcttgccggtgtcgcttcacatcttgcgacaaaacagtacggttctttaaccggctttgcgatgccgttgttgatgctcccgtcttttgtcacggtttccttgtcaaccgcccttgtgcccgcgatcagcgaagcaaattcccggaaaaatgccagacttgttgaacacaggctccagcaggcattgcgtttttcccttttaactggcggcatctcggttgtcatcctgtatgtctttgcagaaccgctcatgcaggcgatgtacgggacggcaaacgggtcacagtttatcaaaatcatggcgccgttttttattttccaggcatgccaggcgccgctccaggctgcactgcaggcaatggatctggcaaaagcggcgatgatcaacagcatcatcggggctgtcgtgaaactgggcaccatttttgtccttgcttcccgcccggagttcgggatcaacggcgccgcgatcggcatcatggcgggaatggtgcttgtaacatttcttcattttgcaaccgttttgaaaaaaatccagtttaccctgtatgtccatgactgggccaagcttctggccgtttcggtcgtttccggcgcggtcgggcactggtggttcaccggtatgatggcacaagacgcatctttcctgcggcttttagcgggcatttgtttgaccgtggccgtctatacgctgctgcttataatgacaaaattgatccgccggtccgatctcatgtatattccgatcctcaaaaaatggttataaaaaagcaataggccctgcatgttccggccgggcttattgcacatcatccagatcaatataaaacgcgccatcctgataactgcaaaacgaaatccgggcgatatccccgtaccctcttttttgcagctcgctgcgcagccacgcttcggttttgttgcttttctttaaattgctttgctggatcttccctccgacaatgagcggttccgtataggatgccggtttgtttttatttttgttttttttcaccaccgacagctgcccggaagtttccaaaatcgcaaattccacatccgcaatattatcaatatcttttgaacggagctgcattaaaaggtcgtcaaaattgtaacgctgcctgcgcatttccttttcatcgatttttcctttattgatgagaatgctcggcttgccgtcaatcagtttgcggatccggctgctgcggagcgagaaaagtgccagcgcgatttggatgccgagcaggacaaccattggcaaaagggtatttacaacgggctcactgtgattttcaatggcgacgaccgccatttccccgatcatgatgaacacaacaagatccaaaacgtttagttcgccaatctccctttttcccattaaccggaaaataacaagaatggcaacatacatgagcagtgtccgaaaaaaaataatcaataaattttccaacgccaatccccccgttcggtcaaggtcaaaatcatgtttagtatgctcagcctgcgaaaaaactttctaaaaatcttttgcccggttctttttgctgtttccaggcatatgcttgtactgaggaaaaagcttgtcaaagggggagaatgaaaatcggagcgcaaaaatacagtatcggccttgtttacgggctgggcgtcatttttgtcctgcttgccatatcaagcctcgtgatttcactgattctgcggttttcggatatgacggagcatgctttgcatacggcggtcacgatgatttcttttttcagtttatttctcggggggctcgtcggcggcggaaaaggaaaaaagaaagggtggctcctcggcagtttgacggggatcctctacacagcgattgtttttctcgtccagtaccttggttatgatgaactctttacggtgaaacaagccatttaccatgcttgctatattgttgtcgccgcaatggggggcattttaggggtcaacctcttctcaggaaggtcacgggaatcctgaaaaaaagcgccgcattacacggcgctttttttatttcgtttctccggcatttttttctgccactgttttgtctgctttctggctttcgacttttgcttttttcgctgcaacggattccgttacttcacggatcgccgagcggtcaaacgtcagccgcgtgccgttatcgcatcttaagacgactttattttcatcaatcgaatccacggttgcatgcaagccgccgatggtgacaattttgtcccctttcgccagattgctctgcatctgctggatgtttttctgcctcttttgctgtggcctgatgagcaggaaataaaacaggacaaacagaatcaccaaaggcagtaactgagcccacgccatctgaatcctcccttctttagttgcttgtattagaaattttttgcatccggacggttaaatccgtattgctcaaaaaattcttccctgaaatcaagcagccggtcttcgcggatcgcctgccttacattttccattaattttaacaaaaaatataaattatggtaagtggtcagacgaattccgaaagtttcgccacatttaatcaaatgccggatgtaagcgcgtgaatagtgccgacatgtataacagttgcaatgctcatcaagcgggcggaaatcgcgggcgtactgcgcgtttttgacaacgagccggccggctgatgtcatcaccgtgccgtttcttgcaatccgggttggcagcacacagtcaaacatgtcaatgccgcggatggcgccgtcaatcaaagaatcgggcgaaccgacccccatcaaataacgtggcttgtccgccggaagtagcggtgttgtaaattcgagcatccggttcatcacgtccttcggctcgccaacggacaggccgccgatcgcatagcccggaaacccaagcgaaacaagggcatttgcgctttcaagccgcaaatcttcatacgctccgccctgtacgatcccgaataatccttgcacatccggacgccgatgcgcacgaagacagcgttccgcccagcgcgatgtcctttccaccgactgcttcatatattcataagaagcagggtacggcgggcactcatcgaatgccatcatgatatcagaaccaagtgcattctggatttccattgatttttccggcgacaaaaacagcttgtccccgtttaaatggttccgaaaatggacgccctcttccgtaatatcacggatcttgctcaggctgaagacctggaatccgcccgaatcggtcaggatcgcctggtcccagttcataaatttgtgcagcccgcctgcttctttaacaatatcatgcccggggcgcagccacaaatgatatgtattgctcaaaatggtgccggcccccattgtttttaattcttccggcgacatcgtcttcaccgtggcgagcgttccgaccggcatgaacattggggtatcataggtgccatgcggcgtatggagttttccaaggcgggcgcccgtatgcttttccgttttgatcagttcataagtaatggcagccaagtgatgcgctccttccactatttaatcagcatcgcatccccgaaactgaagaaacggtatttttcttttaccgccgtctcgtaggcatgcaaaatattttcccttcccgccaatgcgcttaccatcataataagcgtcgacttcggcaggtggaaattggtgatcagggcatcaattgctttatattgatagcccggataaatgaaaatatccgtccaaccgcttgaggcgacgatttttccgtcatgggcgcttgccaccgtttcaagtgtgcgggtggaggtggtgccaacagagaccacacggccgccgttttcttttacttccgtaatcgtgcgggccgcttcttctgatacctgataaaattccgcatgcatatcgtggttttcaatattttcctcattgacggggcggaaagtgccaaggccgacatggagcgtaatatagacaattttcacgcccattgcctcaatttctttcaataacgcttccgtaaaatggagcccggcagtcggcgctgcggcagaacccggctcttttgcatacaccgtctgatagcggtcctggtcctcgagttgttctttaatatagggtggcagcggcatttttccgagttcattcagcacttcgtaaaaaattccttcgtactggaaatccattacccggccgccatggtccagctcctccgcacaaacggcggaaagctgcccgtcgccgaaccggacaaccgtccctgttttcacacgttttgccggtttgacaagcgtttcccagcggtctccttcgagctgttttaaaagcagcacttcaatttttgcgcctgtttcgtcttttatgccgaaaagccttgccggcagcacttttgtgttgtttaagacaaggcagtcccccgggcgcaagtattgtgtaatgtttttaaatacgctgtgttcaatttctcctgtttttttatccagtaccatcagccgactgtccgaacgattttttaaaggcgtttgggcaatcagttcttccggcagttcataatcaaataaatcgagtttcattgttgtttccccttcattttgaatcccatttgcggttatttgaaccgtccaatgatatataataacacacttaagatcacgcttaaaaggatcgatgttgcgattggaaaataaaaggttgtgttcccttttttaatgaggatatcgcccggcagccggccgattttcgtaaactgcatcaacaggccgatagcaaaaagaatcacggcgatcgtcatcagcacttttccaaatccgctcattccggtacctccatatgaaaatgtgcgtagcaaagcggggtcgctaccctgccgcgcggcgtgcgctgcaaaaagccaatttgcagcaaatacggctcatatacatcttcaatcgtttccctttcttccccgatgctggccgcaatcgtgtcgagcccgacaggaccgccccggaagcgctctatgatcgcttttaacagcttatgatcaatatggtcaagcccgcgtttgtcaacttgcaaaagttcaagggcataattggcgatctcaagggtgacctttccgtctcctttgacctgggcaaagtcgcgcacccttcttaacagccggttcgcaatccgcggcgtgccccgcgaacgccttgcaatttccgctgccccctcaggctcaatcgccgtctcgaggatgccggctgtccgcagcacaatttccgccagttgcgcttcgttataatattcgagccggctgatcaccccgaaccggtcgcgcagcggtgctgaaaccgaaccggccctcgtcgtcgccccgatcaaggtaaatgggggcaggtcaaggcggatggagcgggcacccgatcctttgccgatcacgatatcaaggcaaaagtcttccattgccgggtacagcacttcttcaatcgctttcggcaggcggtggatttcgtcaataaacagtacttcccccggctcaagcgcggttaacacgctggcaagatcgcccggccgctcgatggcaggccctgaagtcgtccggatgttcgcgcccatttcgtttgcgatcacggtggcaagcgtcgttttgccaagccccggcggaccataaagcagcacgtggtcaagtgtttcgcgccgccctttcgccgcttcaataaacacggctaaattatgcttcacttcatcctggccgatatattgcgcaagggtttgcggcctgaggctcatttcaaaggaaacttcctgttcatttgcctcgccggaaactacgcggtcttccatgctctcccctcctccattattttaccattgcttttaaagcgagtttaatatattcatccgcagaaagcacttcttccggaagtttgggcaccactttcgcgatttctttttccgaatagccgagcgccgccaaagcgagcatcgcttcttcgaggttttggttggtggatgcaggcaccgctttttccccgcctgcctcgtccggcatctccggcacgaggccttgcagctttcctttcagatcaagaatcatctgccttgccgtttttttgccgacaccggggaatttgacaaggaaagattcattttcattctcaatggcgtcaacaacctgctgcggctgcccgtacgcaagaatggcaagcgccccttttggcccgatgccggaaacattgagcagcttttgaaacagcgcccgttcttccgccgtttcaaaaccgtaaagcgcgatcagatcttcgcgcacatgctggtatgtaaaaatttttcgttcttgtccgatgctttttgaaaaaatatacgggttcggcgccagcagccggtagccgatccccccgttttccacgacaatgtaatccgggctcacggaatcaatgatgcctttaatatattcgtacaaccttcccacacgctcctcaaaaacttgctatcccatattgtaccacagaatgcaaccgttttgggaacgaatgtccggtccctcctttttttccggccggatgattcctaaggctgggcgcttttcctgtttccatggcgaaaggaaacgcctgcatccggagacagatccgtgtccgtgtggcataccgggctcactttttttcgaatactcgctgcctcttaacgaccttcccggatttccagccgaaaccatcgtccgggttttaacggcacgattctttagccacagtgcagccggtttaaaaacggcatggtcccctttccgcagtgcaccggtctaaaacagcatggtcctctctcgtagtgcgccggtttaaaaacagcaagggccctctccacagtgtaaccggttggatacagggctaaccggctttgctgcaaaaaagtcactttccgcacccggccggaccgggtgcggaaagtgactgggacattatcattcggcgttatggtaaacttcctggacatcgtcatcgtcttccagcctgtccagcaatcgctccatcttttctttttgcgcttcatccaaagcaattgtgttttgcggcaccatggtaatttctgctcgggcaaacgtaaagccttgttcctcgaggttcttcttcacatccatgaattgctccggatctgtataaatttcaaacacttcatcgctcgtttccatttcctcggcgcctgcttcaatcgcggcaagcagcattccgtcttcatctatctcgagcccttcccgctcaatgacaagatagcctttgcggtcaaacaggaaagacacgcatccgttttcgccgagatttccgccgttgcgcgaaaacgcaacacggacattggaagcggtccggtttttattatcggttaaagccttgaccatgacggcaacgccgcccggcccgtacccttcatatgtgatttcctcgtaatgttcggcgttttggctgccgcttgctttctcgatggcgcgtttaatattgtcattcggcatattggcggcctttgccttttcaatgactaggcggaggcttgagttcgcttccgggtcaggcccgtttttcgccgctacataaatttcctttgccagtttttgaaagatttttccgcgctttgcatcttgcgcattttttctgccttgaatatttttccatttggaatggccggacatggccatcactcctttctgacagcgctgatacagtcccctattactataccatactcgcccgaaaggaggatgaaaagcattatgctggccgtaagcgtccaggtttttccgttatgcttgcaaacgcctttttacttctttttgaaagcgggcgcgttccccgaattgcccgatggaaagcagggaaagatgcggccagtactgctctttttcttttttgccgcttccaacaaaccggttccactctcttaaaacatccgtcgggtaaaggagcgcctcaagaaaagtttccctgtccggcgcaccgtccagcattccccacttttcaagagcagcaagcgaccatgaagcagcgggcaaaacccggttgcaaaactggagatcatcggtccaggccggggcaaggcgggcaaggtcaaaatcaatcaaatacagttccccgtttttcgcacgcaaaaaattatggtgggcaacatcaccgtgcgtgatgcaatacggcggacggtgaagcaaatgctgttttttctcaagccggtttaacgcctcggctgcccatctttcgtacgcggcaaaatacgtttccggcaaataccggacaatttgttctttgttttccagaaatgtccggtaccgcgcctgccattttctcagctggaaaaagcgcggaaattccatttttacggcttgcggaaagtgcgcggtcttttcgtgatactgttttaacaggcggaaagcggcgtggatgtctgcttccgtcccgaaggtaaaaccggccgggtcttcttcaatgtatgccataaacccaaaagctttgccttgaaaggggctgtcgttgtcatcttccagaaaacggcaagtttgggtgaaaccgcttttccgcagttccgatgtaagcagcatttgccgtttaaggcgcgtatcggaaccatattgcttcatgatcactttctttgtctttgttccgataagccatacccggtcacgcaacctgcgccagtcaacaatcggttcctgcagtctgttttccgcataaagaaggagacgtttggtttcgtctccctcttgtctccggccgcccattatttttcttcttcgccggaaggatcccgtttttcctgcggctggtccgttttttcgccccggtcatatccgaacggggcctgcatcccgtacggttcctgcatgtcgtatggtggttgcgacatcccgtatggcggttgcggcatgccaccaaatggttcctgcatgccgtacggttgcggcgccatcccgtacggttcctgcacgccgccgtaaggttgctcctggcacccgcatggctgctggtgcggcggatacggggcgtactgcggcatcgtttgcggcggcatgtactgcggcatataggcggagctttctgaagcagcgccgtataaaggagcctgctgcgctccccattgcggcgcggcggcaggatgttgcgcagaaacccccgcttgcataccggggccatacggataaggagaagacgaagaggattcttcttcccattcataacctggcatcacttgctgcccctcatgccatgccggctgctgctgcggcataaaccctgccggcgcggccatcgccggtatttgcgtgaaccctgttggcgcggccatcgccggcatttgcggataggccattgggtacggcatcggatatgggacttgcggatatggcatgctgtaaggaggcgggaaaaatccggcgtgcatgtcccctcccccgcagccgcaatcgtataccggcatcacgggcggacacggattatacggtacatacatttccgggcactcttcctttaccggcatggtgtagtgcacgctttccgacgattcgctttcatggtgcttcggcggcggtgcagctgtatgggtttcgatttcagccatattggtcacatagtaattatggatgtcaatttcaggaatgaccggttgcggcatcaccggcttataaatcgtttcttttttttcaaccactttttctttcacctgtgtttctttcggtgctggcgcttttggcacctcttttggtaccggcatttcttttgcgacgggcatcttggcctcaggcatttgctcgtacggatgggtcacgagcggcatttcttttgcacccgcgtggcccgtataacctgcatggcctgtatgtgtctctttttttaccatgccgcccgttgtcggaactttaattttcatgccgggcataatcatttccggattggataattgcgcattcaattttttcaattcgtcaaaatcggcgccgtattttttggcgattttccagagcgtatcgcctttttgcacgatatggattttcacacatttcccctcctcaaggcttaagtccatacattctatgtggtgccgggcaaaatgcgattgattttacataaaaacttatgaacgtcccgcgtcctttatgccctttaaagggttgattctttcatcccggcgccttcgtatgataaaatccgaatgaggccgaatgaatggggggaaacgctgttggcagagaagaaaaaaattcttggggatgaaaggcggcatttgatcctcgaatggctgcagaatagccgggagccgattacgggcggggaactggcaaaaaggacaaatgtgagccggcagattatagtaaatgatattacgctcctgaaagcgaaaaacgaaccgatcctggcaacgagccagggatatttgtacatacaccccgccggtgcggaaaacaaagtggagaaaacgcttgtttgtatgcatagtcgcgaacaggtcgcagatgagctgaatttgctcgtggaccacggggtgaccgtaaaagatgtcaaggtggagcatccggtatacggcgatctgaccgcctcgatcatggtctccacccgcgcagaagtggcccggtttatccgccaaattgaagaaacaaatgccagctacttatccgaattaacaggcggcatccacttgcatacggtggaagccgcaagcgggcggcaggttgaagaagcggaacaggcgctgaaagaagctggcattttatttgcagaaaatgaaaaagagctgccctaaacataaaggacagctctttttcatcacccatccggcctaaaaacctgggtttaaagcttgttttgcaaaaaaaaaataagcccgggttccagccgggcttatcctaacattcttgaagaagcgatcatcatttatccgccatatacctataataggtcccgagttctttcacggtgcagccgagcgcgtggatttcctcaagcgaaaagcggacgagcttttcttctaaggagtggttcaggtcaatcataaaaaagtagtttccaagccccgtctttaacggccgcgattcaagcttgctcaagttaatctttcgccaggcaaaggcagacaacacctggtgcagtgatccggccttgtccgtcggcaatgtgaccatgatcgtcgatttcaggaaatcaggcgttttttcgatatgaagctcctcatttgaaaggacaatgaatctcgtatggttaaacggataatcatggattgcacgcctgacaatttcaagaccgtacagttccgctgccatttcgttggcgatcgccccccatttcagttccgggtgttcgcttacatatttcgcagcagcggccgtagagcccattgcttccacttccgcatgccggaattcccggcgcagaaactggtggcactgcgcaagcgcatgggaatgggaaatgattttttccgtttcccgccaggcgccggcatttgcaggatgaaccataaaatgctgctcgatcggcacaatgatttccgcgcgtatcggcggcagttcttcatgatacaagtaatcgaccgttaaatttaccgaaccttccagggcgttttcaagcggaacaaccgccatatccacctgttttgtcttcacggcttctagacattccggaatcgtccgatacgcaacccggctggcctccgggaacactgactggaccgcgatatcggtaaacgtcgcttccggcccgaaaaaagctgctttcatttcctctcccccgccggccggagttctaggctccggaccctaatatttctactttattgacaaactcaaatgcctgcagttcttccagcagatcatttaaactcctgttgatcccggacacattcagcgaaacagtgacatttgcccgcccctgtatcggaatcgtctggtgaatcgttaaaatattgcatgagtaagatgcaataatccttaaaatttcggataatgtcccggaccggtcttccaaataaaaaaacaaggtcacaattttttcttttacaaccgaatggaacggaaaaacggtatcgcggtatttataaaaagcgctgcggcttaagcccgcttttttcgccgcgtccccgaccgataccgcttgtcccctttccagcagttctttcgcctgaagtgttttgatcatcgcttccggcaaaacatcctcacgcaccaagataaacttatgctctgctttcttttccaaagtgccctttcctccactcgggagccgggattccccggcccagcacggttaatctacaaattcaaactcaaaatccaaaaggcggacggtatcgccgtttttcgcgccgcgtgcacggagcgcgtcatcaatgcccattccgcgcagctggcgggcaaatctccggacagactcgtcatggctgaaatttgtcattttaaacagcttctcgactttttccccgtggatgacgaagctgccgtccggatcgcgtgtaatggtaaaatcggccttttctttttcatgcttgtacaatacacgggacggttccgcatccggttcttcgccagcatgaagcgggaaggcaggtgtttcatcgagcagatcggcaatcgcaaacaaaacatcccttaatcctttgcgcgtcaccgcggaaatcgggaagacgcgtgcgacatcgcccagcttctctttaaacgccgccagattttcttccgcgcccggaaggtccattttattggcaataatgagctgcgggcgctcagaaaggcgttcatgataagctttcagttctttgttgatcgtcaaataatcttcatacgggtcgcgcccttccaccgccgccatgtcaatgacgtggacgatcaaccgcgtccgttcgatatggcgcaaaaactggtggccgagcccgacgccttcgtgcgcgccttcgatcagccccggcagatcggccatgacaaaacttctgccgtcctccgtttcgactacaccgagattcggcacaagcgtcgtaaaatggtattccgcaattttcgggcgtgccgaagagataacggaaagcaaggttgatttcccgacgctcggaaaaccaacaaggccgacatcagcaagcagttttaattcaagaacaatataacgttcctggcccggttcgccgttttcggcaatttccggagcgggattggccggtgtcgcaaagcggatattgcccctgccgccgcgcccgcctttggcaatcactgcccgttccccgtggcgcgttaaatcggcaatcgtttgttttgtatcatcatcaatgacgaccgttcccggcggcaccttgacaatcatgtctttcgccccgcggccgtgttttcctttgctcatgccgttttcgccatggtccgctttaaaatggcgcttgtagcggaaatccatgagcgtccgcaacccttcatcgacttcaaaaatgacatcgccgccgcggccgccatccccgccggcagggccgcccatcggcacatatttctcgcggcggaatgcgaccatcccgttgccgccgtccccgcctttcacataaattttcacctggtccacaaacataaaagataaaaccacctttgcaattgctgtatcgttaggctttcagaaagattatttcaaccgggaaagcggattgcgggtacgcgtggatcacgttcatccccggacaatcgttttccagaaacccggcaagcagtccgtacttttttattgtaccgctaaactcgaaaaagaaacgggcgccggatggcaaagtgctgaccgacaaagataaccggttgtctccgtttggatcgactgcttcttcaacgatagcgaaaaaattcttcatccagccggtcagctccctatcgtccggtagcacattccggtccacatccaatatttcgtatgcaatccgcaccgtgtgcccttcccagttatatgtaagcaaaagctcggcaaattccggcagatgcaaatttgataattttgactcctgctgcgcttcccggataatgtcttccacaatatttttgaccttttccattttgttcaagctggcgtatcctttgatcagctgcaccttgttcagccagtcatgcctggcgtggcgaagcacgtcaaccgtcgtccattcccgcattttcatagctcccgttctccgaaataggttatgtttaagtatagcaaaaattgcctcatgttgcacgggacgcgaatgatagcggcatgtgcccggcactcgccagaagaacgcggcaacccgttttttgtacgtttttcagaacgggagtggtttattggaaaatgcaaaagccccgggccgcgaatatcgcagcccggggctttatgggttaggcttcttgtgccaccggatatacgctcacttttttcttgtcgcggccgagtcgttcaaaacgcacaacgccgtcaactttcgcaaacaaagtgtcgtcgcccccgcggccgacgttttcgcccggaaaaactttcgtcccgcgctggcggtaaaggatcgagccgcctgttacgaactggccgtccgcacgttttgcgccgaggcgttttgcaatcgagtcacgaccgtttttcgtggagccgaccccttttttggaagcgaaaaactgaagatctaatttcaacatgatgctcacctcctattcaaaggttatatggataaattcgccgtattcccgttctatcgtctcgagggatacaaccatgccttcaagcagaatctgcacttttgtcgcctgttcttccgaaagatgcgaagggattttgcattccaaaaggcctctttcggactggcggatttcgggttcaacccccgccacttgcataatggcgttcaccgtcccgaaagaaacagcggaagcgccggcacagacaatgtcctggccgtattcggcaaattcagcatggccactcatttgaaaagatgagatgttcccattctttttgcgtttgatgcggacccggatcatgccgcgtgcaccttacgcattgattttttcaatgaccacttttgtgtacggctgacggtggccttgttttttgtggtaatttttcttcgctttatatttgaatacaacgatttttttcgcacggccgtgtttttccactttacccgtaaccgtagcgccttcaacaacagggctaccgacttttaccgattcgccgccgacaaaaagaacgcggtcaaatgtaaccgattcgccttctgctgcatccaatttttcaatatatacagcttggccttcttctactttgatttgtttcccgccggtttcaataattgcgtacatcactgcacctccttaagactcagactcgccaaagacaggcgttttacgaaatgtaaaaacttgcaaagcctgttcctgagcggttgtagcacagggcgctacaaacataacatactgatggtaacacacactttttcctttgtcaattgggatctttgccttttgcggcaaggccggctgccgtcccgaactgccggatggcataaaacggatgcggatcgcgagtgatgtgaaaaatgagtttcatgccgagcaggttttccagccgctttaaatgtacgtccgtttccccgcaaaaacagtccttcacatcttgcgtgcattcaatcaagacggcttcgtaatccgcgtacggcgcttcccacagctcgcgttcgaggcggaaagcaagcgtctcggggctttcgattttgccgctgcccccgcagaccgggcaaacggaaagcagtgcctcggggagcgatttacgcgttttcttgcgcgtcatttgtaaaatgccaagctccgtaaaaccggtgatgcgggtttgtttctcgtcattttccagttctttttcaagcaccgccctcacttgtacgcgctgttcatcgcgctgcatatcgataaaatcgacgagaatgatgccgccgtaatcgcgcagtttcagctggcggccgatttctttcgccgcaagcagattcgttttcagcaccgtttcggcctggtccgttgtgcccgtatattttccggtattcacatcaataatggtgagcgcttctgtttcgtcgatgacaagataggcgccgttttcaagccagaccactcttttcaaggcatcctcaagcgtccggtcgatacggtagcgggtaaaaatattctgttttccgctgtagagctcaaacgaccagtccagttccggccggcccgcaagcaatgctttcaggcgggcaagtgcctccgcatcatccacgatcaccgtgccgctttttaagcggacaagttcgcggaaaatttccgcttccaccgtgcttttttcgtgcagaacagccggtgctttcagttgtgccgccttttcgagcaggcatttgtaccgaagcctgaggcattttagttcatcgcgccacccgtccccgccggcatggatggctgcggtccggacaatgattccttcctgcggttcaagcgctttgcggaccctgttccgccacttgttccggtctgcatcatccgcttttttggaaacagccgtgtactttccttccggcagatacacaatctgttcccccgaaagctcaatgatgccggttaaaagcggacctttttgccctgtttcatcttttttcacctggaccataaccgtctgcccgggcgaaagataagctgaaatcgttggattcgaatttttgctgttcacaaaagcagggagccggctgatatgcaagtaaccgtgccggatgccgccgatatcaataaacgcggcattgattccgggtttgacgtctgccaccttgccgagataaatattcccgacttttgccgcatcgcccggctgccggatgcggatggcagatactttgccgttttcgatgaccgcatatcgtttttcccttgttttcacgttgatgatgattgatctgtccaaaaaattccaccacactgtcttcgctttcagccgcttctattgcggcttccatcaataactatacaggatatcgcttactttcgcattggtttgcttctcggaaaaaaaggcatgaaggagttcattttcatcaagcttcccgacttccaccccgtttttaaggacaatgagcggatgtttgcgtccccgtttaaagctttcgagcacttcatacaagtatgcgcccgcatccacctcgatcgtttccagatgacggagcggatccctttttccataataccgttcaagcaggaaacggataaaaacaaagtaaagctgtttccattctttccaaagggcggcatataaataaacggcgatcgcccagacgttcaaatttgccggcgcattcagcagggcggccgcatgaaaaaggagcagcacgataaacgaacagcaaatcgtcatccggaatgcgcgcaaaaaaggataaaccgtggaaaacgccatattcagcaatttcccgccgtcaagcggccaaatcgggagcaaattaaaaaaaagaatggcccggttccactccccgatttgcgtatacatctgtccaggcaagacatcgaagcggaacaacaaatacgcgaaaacggcgatccaaacatgctggagggggcctgagagtgtcacgatcagttcttctttcagcgggcggtttccgtgttcctctgtttcagcgacgccgccaaacggcaaaatggcgatttttttaacccgccatgaaaaatattgcgccgcaaccgcgtgccccatttcgtgaatgaaaatgatcgcaaacagcaggatgagatcttggaaacgggcggtaacagcagcaatggcagccacgagccagaaaaggggatggattttgatttttttcagaagccaaaaccgctcactcaaatttaatcacctggatcggatcgataaaaccgccgtcttttttaagcgcaaaataaaattcccctttttccccgctgcttcgcgccgtgccgaccttttcgcccatcttgaggctgtcatactggcccacatcgattttgctgaggtttgcgtaccatgtttccgttgaatcggcatgctggataataacggtattgccgagttttggctttttcccggcaaaaatgaccgtcccgccgctcatcgctttcacgcttgcgcccggctttgtttcaatcgtaacccctcttccatcggcagaaaaacgggtcagaatttttcccgataccggcatggcatattgcgaatcttcattggaagcagcggtttccgtttttgacgatttttccgggaagagcgcaaccggcttgccaaactttttttcataccaggcggctgcttttgcaaattgaaattcggacgccattacctgtttgacggcggctttcggtttgtcaaattccggacgttccgatttaaacagaatcgccacaacgaggacaagacaggcagaagccagaattttaaacagcatcgtttcttttttaaaaagcggatgcggcgttttgcccggcggttcatatacatgtgtgccctcatctttgatcaggctcgcatagaccgtttctttgccgttataagcctgcttgatcgtttttctccgcttcgccatttgtctccggatttcatcggcgcggtttcccaatcgattcaccccttctgtacaggcattcgtttattaccaatgtatgacctgtccaaagcggttagaaccgggaacaaaacaagccgccctgatcgtttggaaaaacgttcagaaacggctctgctattaagaagatttcgaactgaataattttttaaagcgcgcaaacatgccgggtttctggtcttcaagcggcattaaaggcaccgtttcccccaaaatccggcgggcaatattccggtaggcaagggaggcgcggttcgtcggatggagcgcaatcggttcaccctggttcgaagcgcggatcacttcttcatcatcggctacaatcccgatcaaatcgattgataaatggcttgtcacttcatcgatgtccagcatgtccccgcttttcatcatatggctccggatccggttgatgatcagtttcggcggctcgatatgttcttccttttccaaaagcccgatgatccggtcggcatcccttaccgccgagatttccggtgttgtcacaacaatcgcctggtcagcgcccgccactgcatttttatatccctgttcaatgccggccgggcagtcaatcagaatataatcgtaatcctgttttaacccgtggatcaattgtttcatctgttccggcgtgacggcggatttgtcgcttgtctgggcagccggcagcaaaaagagcttgtcatcgaaacgcttgtcctttacgattgcctggtggattttacagcggccttctacgacatcgactagatcgtagataatccggttttcaagccccaacaggacgtcaagattgcggagcccgatgtctgtatcgacaagacagactttctttccgagaagcgcgagcgcagtcccgaggtttgccgatgtcgtcgttttgccgacgccgccttttccggatgtaatgacaatcgcttcacccatatgagaaccctccttttaatcttgtcatattcggccgcaaagttttcaacacttgcaatttatcaatgataatatggtccgattcatctatgtaagcacattccatctcatgccggtcttctttcccgtaatcatcaggcgcccggttcagacaatcggcaatccggatttgggacggaaccatattggaagcgacaacaacggcgtcccttctcccgctgtaaccggcgtgcgcaatgccgcggaggtttcccatgataaaaatattgccgtttgcaatcacggttccgcccggattgacattgccgacaagcaaaagatcgccttccgcctttaacacctgaccggaccggacgatggtggtaacaggcacaatttcattttccactttttcgcgcgcagccgcttcttttgtaatgacattgctgatgattttatcgacaacaaggttccgccgggcacgcacaaggcttttgatctcttcttcctgcgctggcgtcaaatagcggttgccaagctgaattttgacggcaaggatcgggctgttttcctcctcatcgacagactgggccagtaatttttgttctaattccgcctttaaagcttgataggagcattggtcgtttaaatgcagcacaattccgtctttcgtgccttttatggttacattttgcgttttcttcatttcaaactgctcacctcaacggctcaataaataacgacacatccgaaatggctttcagacggcgttttgcggcccggcacgcaggaataagcctccgtgcgtgcggttccggctggtttcggcccgcaaacccttttgctttttccattcccccttgtccggatcattcgacaaaaaggcggaaaatccttctttcccattttaacagattttctccccgccggttattccttttcttcttcccttgcacgccgctttaaaaaattccccatcggataccatgccaaaataaaaaaagcggcatttaaaatcaaagtcggccaaagcctgagcaagagaaaatcgtcaaatcccatcacctgcggattaattaaagcattgatgccatagaccaaaaattcgacaatcgccatgttcaagactgccacaagcgtgccggtgaaaatattggactggaggatcctgtccattttttctgtcaggtaaaccgcaagcggatagaaaaacagataaacgcccagaatgcccgtgtaaaaagcatcaaacagcatgccgaatacaaaggcataaatgatggagagcctttttcggtaatgcatccccattaaaatcagcataacgagcagaaaatggggaacaatggtaaattttccgccaaaagaacgggcggcaaaaaattgggcaaataaactttcagcaatatagcacaggcttaaaatcagagggagcacgatccgtttcatcactgctctcctcctgcgctgcctaggttcactgctttccggttgatgatgagcacttcgcggacatcataaaaattggctgccggcttcacataagcggtttgcgtcagcccgttttcatccggggttactttttcaatgtcaccaatcagaagcccgctcggaaacatgccgcttaaaccggatgtcacgacatgatcgccttttttgactttgatattaaaatcaagctgtttcaaaagcagcatttttgcttttttgtcgtatccttcgattaaaccgtaagcgtcttttttggcattttgcactttggcggatacgcggttcgtttcatcgggcgagctcaaaagttcgacggttgaataaaatttgtcgacctgcgtcacttttccgaggaaaccacctgaagtgacgacagccatgtttttggtaacgccgttgacttcgcccttatctatcaccacttgctcgtaccaattatccgggttgcgtgcaatgacctgggcctgaatggactctgaatctccaagactgtttttttcctttataatagatctcaaattttcattttcttttttcagttcatgattttgcgcttccaggcttgtcagctgttccaaatgggatttcagttttttgttttcagtatatgtattttttaagtcctcgatattgtcaaaaaaaccggcaagggcattggcgggtttggcaatgacggactggccgagcccgacgatatcgcgcacaaactgttccggttttgaaatccggtcgcgttccctaatggaaaatccgatcatggcgacaagcagaatgacactgattaaaaggacgatcaatcgtttattcaaaaaaaactgtggcataaaatccactcctataacactttgttccggccattcccggattgaaaaccattctcccgccagaaaaaaccggcaggagaatgcgttaacaggacactagcatgtcctatttagaattttttgctttgtttttaaacagttcgatattttcgagcgcgctgcctgttccgattgctacgcagtcgagcgggttttcagcaatcagcaccggcatttcggtttctttgctgatgacatggtcgaggttgcgcaacagggcgcccccacctgtcaggacgatgccgcgatccataatatcagctgccagttcaggcggtgtctgctcaagcgtgtatttgaccgcatcgacaatggcatacaccgtatcgtggagcgcatcggccacctcatccgcggtaatcgtgatcgtcttcggcaaaccggtcagcaaatcccggcccctgatatccatcggttcgatcccctccggctcacctgctgaaccaatttccattttaatttgttctgcggttcggtcccctattaaaagattataatttttgcggatataactgatgatcgcttcgtccatttcatccccggccacccggatcgactggcttgtcacaattccgcccagcgaaataatcgccacttccgttgtgccgccgccgatatcaacaaccatgcttccggtcggctcccagacaggcagcccggcaccgatcgcagccgcaaaaggctcttcaatcgtaaaagcatcccgtgccccggcctggcgggttgcatcaatcaccgcgcgctcttccaccgccgtaatgccggaagggacgcagaccatgacatacggattttttgaaaaaaagccttttttatttgtggcctgctgaatataatatttcatcatcgccgccgtcgtttcataatccgcaatcacgccgtctttcatcggccgcgtcgccacaatgtttcccggcgtcctgccgatcattttttttgcggcatccccgactgcgacaatctgtttcgtatccgtctggatggccacaacggaaggttcccgcaccacaattcctttcccttttataaaaaccaatgtattggctgtcccaagatcaatccccaggtctttacttccgaacatggatgtatctccctttctacacgataaattttcatcaccagttggtgccatacttttgcttatttatggatgtcactttaaatctacatccggaattcaggtatttccggcgcagtgccggccgtaaaaatcatacgatttattatatcgtaaccataaaaaaattcaaagccttacaaataccctttttgtctcagacttacaaattttttctcaccgatgatcaaatggtcaagaatctcaatccccattattttaccacattcggcaagccgtttggtaacttcaatatcttctttggaaggagaagggtctccggatggatggttatggaaacaaataatggaagcagctgaacgcctgagcgcttctttgaacacttcgcggggatggacgatcgaggcatttaagcttccgatgaaaatcgtctgccggtggatcacctggtttttaatatttaaatacaggcagacaaaatgctcctgggataaaaagcgcatatcattcatgacataattggccccgtcttgcggcgtgcggattacataacgtgtatcgtgctgcaaattggcaatccttctgccgagttcgctcgcggccagaatctggaccgcttttgctgtgccgatgcctttgatggacgtcatttcctcaagggaagcatcttttaaaaaccgcaagccttcaaaatggcggatcagtctgttggcaagctcgagcaccgattcttctttcgtgccggtacggagtaaaatggcaagcagttcctgattggagaggctctccgctcctgtgcggatcaaccgttcacgcgggcggtcttctgcaggaaaatctttgatcagcattttttccaaatgaattcctccttttctggtgcaggaggcgggggaatcgaaccaatgggctttggtatgggagatacaattgtatcgtaccaaaaaacgggccgtgaaacaactgcaaattcaaccttttcagacaaaaaataatgctatgcgggcgcatgcctttatctggcaccacagcctttcagccggaagcccgcatttgatttcaatgcccgctgtagacctttacgtagtccagcaggttttgttcggcatccgttaaatcctgccggttgccgcttttttgataagcaacgagcgattcatacgcggccgtttcgtattttttcaaccggccgagcgtttcctgcctgacttttgccagctttttgacgttgccggctgctgtttcggctgtcttcatgccgtccggtgaaacccgcccgttctggacagcggcggccgtttcttttgccagtttttgaaaaagcggaaccgtttcccgggcaaaaatttgctcatcctttgtcgtcgtttggacctttttgctggaaaaactgatttcttttgcatacagttcgacgcctttatctttccaggcagtttccatttttttggctgtgccgaggctgtcggccacacctgcaaaaatatagcgttgcccgtccatcgaaagctgcatcgacggaacctttttcgcggcaagttcgcgtgacactttagaggcggcgccttccgtgctgaacacccctgcctggatgatgccgatgcttaacgccggaagctgggcctcttgctgcgctgtgcccgctgcagcgccttcagcctgctgtttcgggagttttgtttgatgatcgccgtacgcaatgaattttaatacaacaaacccgagcagcgccccgaacaccaacgcggacacgacagaaaacaaaatcgccggcgcagcccttttcgcaaccgcttttttcgggaatatgcttttctttttgggcgcgggtgtgtaatggatcggccggaattcttcaatctgatccgcatcaagttcgggcagcacccattcaaatgactcctcttcttttacactgtcttcctgtgcggcagccgtttcttcggccgctttccagtcatggactttcacgctttcttccggctgcaccttttttccgcccactttgactgtaattttcgccttttttttcgccttgtccaatgttttcacctctcctgcccgatttgcttcatgctaccataaccggcaaaaaaaagaacaagacttttgtcgtcttgtccgaaaaccattcgccgatttccggcattttatgcaaattttatccgagcccggagatgcgcaaatacatcccgataaggctgtttccgaaaaaataggcggcaagcgcaccgatggcgataaacggcccgaacggcaccggttttcgttttttaaatttgccggcagccatcaaaccaacgccgtaaagcgcgccaaaaaagcaggctagaaaaaaggccagaaaggttttctctatgccgagcacaagcccgatgacaaaaaacaatttaatgtccccgccacccatcgcgccttttgtgaaaaaggcaatgaggtagaggaggcaaaagccgaaaaccgccccgagccaggcggaccaccacggtgacgccggatgaaaaagccggacggcggcaatggcggctgcaaaaggaaacagcactttatcgggaatgagcatatacgccaaatcggaaacggtaatgatgacaagcagtgaaataaacaaaacggcaagcaaaaattcgggactccacccgaaccggtaaaaagaataggcaaacaagcccccggtcagcgcctcaaataccggatagaccggggagatcggcgcgcggcagcttctgcatctgccccgtaaagcaagaaaagacaacaccggtatattttcataccagcttaacgagtgcccacacttcgggcaatgcgacccgggacggataatcgattcatgattcggcacgcgtagcccgatgacattataaaacgagccgaacaccattcccagtgccgcaaaataagcagtccacaatccatgcatgtttgatccctctgatctttcagcataaggtattttcttggttcgctaccggcaagcaacgggcgatattaagcatatgtaatggcaaggatgaacatgccgaaaacttattgctcctttattgcgaccgggtcacttttatgtcccgctgccggcacgtcgatttccggcaaatagtccgaataccggcttaacgccgggtaataaaaagtggaaaccgtgacggtgtactgcaatccactcgatccaggcgctccttcccccggactgaaattgaggctttcgatcactgtaatgcgcggcaagttttcaatcgtctgtaaaaatgttttcatgctcttgtagctgtctgactccacttttaaagtatacgacagttttttgacaccggcaggcagcacgtctgttttttgctgtgtgccggatgaggtgccgctcgttgtgctttgtgtagcctcctcgctcccggacgtaccggcagagtcctgctgggcgtctgtttccgtaatccggctgccggaaagggcctctgccatcctgaactgaagcagcacttgttccgcaagcggttttgccgggattttccgcaacaggctgacaacattgccaagctgcagttccgggctttgctgtttttttgactgcaggctggatagcacctgctgttccgatttcaacgcagctttttgtccggccagctcggacttagccggcgccagcacaaaccagtacaaaccggctgcaccggcaaggcaaacggcaaagagggcaagcatgataaaaagctgtttccggtttaaacggaggttcattgctgttcctcctttttgctagcggcattgagtgcagtttgattgagctggatcgtatatgtcgcttcatagaccgttacaccctctgcttcaccggttgctgcagtatccgcgccggctgtgccacccgttggcgccggggaggaagaggaaccgccctcgccgttaccaccggatgttttggatgcagcagatgtggaagaggaaccggttttagacgtgcccgaagaagaaccgccgcccgttttggacgcatctgatctggaagatgtgctgcttgccgttttggaagagccgaatccggaagaggaaccggcggatgtgctggatgtgcccgttcccgaagatgaaccagttgcagcgtcggatgtgtcgcttggagaagcactaaccgtttccgtattcattttgatgctgtttaagacggcgccgctaaaatacgggctgtcattcagccgttttaaaaagtaaaccgcttcatcggacgcatcaaactggacggtcacattcgcgcccgtgctactgcaggaaaagtccgtgatatagccgtattccggcaaaagtttagtaagcttgtccaataccggcaccgtcttgaccggcgtatcgcttgcccatttaacggcggacgagagctttttaaaatcctgtatgtccgcattgcttttttgtgctgcctgttcagcggcctggagcgcttccgtctgtttgatttgctgattaacggcagcaagatcctgttttgtctgatggagcgcgataaagaagatgatgacaaaaatggcggctgcaccggccagtatcccgccccaaaagagcagcgcgatatttttcggttcttttttcggcagcaggttaatctcgacaagcatttatttcacctctttcagtgcaaggcccaaaacaggcgcaaagcgggcgggaaatggctgcccggttatggtagatactttttccgtttcgatcatcttaaccgacaggccaaactgctccgcaagattgtccgcaacctcgggcaaatacggataatcgccgttcagcaaaatttgattgaccgcatcctgccctttccggatcgaaaactgataataattcacgattctgtccagctctttataaatatattccatctggtagcggagcagcgggtcgtcttccggccagcggtactttttttcgccaaaagcattggtctccgtctcccatttggaaagcggaatatcgacttcaagctccctgacaagcagcgggaaacgccggtggaaaatggtcgcagtgaccatcaataaatcaaactggagaaggagcagatggtccatcgcattcaacgtattcaaatgataaaaagaccggtaggcgcacagcggggaaatatcagcagcaaccgggctcaggcggatatcgttaaaaaaaccggcataatcttcgacgacatcccggggcgcagcaaataacaacacctgcttttcctgattcgactcaccaaggagcgcaaagtcaaatacaggatcatcaaacggcaaatgaatggtagaaccgagctcaagggtaatataaccttccatttcatccatggcgatctcatccggaacagcaatttggcgcacgacaacaaaattgtcgggcacagcaaaacggaccgggtgtttccccttaagcccccaatcatcaagacattcttcagcgatcatcgcaagcgtctcagcatcagcaattttcccgccacggatcagtccttccggcaaataccgctcacccattttcgaaacaacaggcgggtcagtctgcctcaattcgagaaaacgaatgacatggtctttgaaaatgaaatttccggtttttttcgatgatggaaaaaatgagcgtggcatcatgatggctccttaaatctttgtaatttataacctaaggcttctccattatttaaaagaaaccttaggttaaaagacttaaaaaatcacgtgtgttaaatcattggcttactgtagtgtcatatttagttgatttagcgtttatcccaccaatggttgcatttgtaaatgttactgttaccccatcatcttcgccagtaccatttaatttataaaccattttcccatcactttcacttactgttactgtgtatgatgaaagattcacttcatcatctaagtatttgtctatgtccgttttttgtattattcctttgtcgggaacactgttcgaagatacatagagcttcgcagcattgattacttggacagcatccgatttaatggcactgatttttgagtgcttgatgatggtgttaatcgccgggatcgcgatcgctgcaataatagccaaaatgacaataaccgccagcagttcaatcaacgtaaagcccttttgatttttcaataactttcttttcttgtgtaacatcgtttctcctcctattgtcctagacctttttacctatattatacatggtcctgttgcataatcctaccttttttgtgcaatttattgaacattattataaatttcgaacatcgggatcataatcgcggcaatgatcgtgccgacaacagctgccaggacgacgatcataaacggctcaatcagcgctttgatctggtcggtggcggcttcgacttcggcttcgtaaaagtcagcgactttgccaagcatggcgtccagcgcaccggtttcctcgccgatcgcaatcatctgcgtaacaagcggcggaaagacccagtggcgccgcatcggttctgtcatcgactgccctttttccagcgcatcgcgggcctggcggagcacttttgtcatcacttcgttttcgacgattgcctccacgatcgacaatgcctgtaaaatcggcacggaactggaaaacaacgagctcaatgtccgcgtcatccgggcaatgatcgatttttggacgagtttgccgaaaatcgggaatttgagcatcgcatagtccaaataaaatttactcgttttgtttttgcgcaaaacgaccagcagcacgtacaccccgatcaaaatcagcacgacgagccaccagtagtgctgcataaacccgcttgccgacaaaacaaggcgcgtaaccgcaggcaggctggctttatagtttttgagcatcgatacaaaggtcgggacgatttttacaagcataaaaatgacgacaacaatcgccatcaccccgacaaaagccggatacgtcagcgccgaccttaccttttgccttgtgcggtgctgcttttcgtagtaggttgcgagcctttccaatgtaccgtcaagattgccgcccgcttcaccggcataaaccatattaatgaacatcggggtaaacacttttttatgttttgcggccgcctgggaaagcggaatcccgccacgcaaatcttcctcgacggccaaaagcgttttctttaatgttttgctgctcgtctggctggcaagtatgtttgtagaatcgacgacggttacgccggctttcagcagtgttgaaaactggcggaggaaaatgacaaaatcctgcagtttcaccctgccgccgagactgatttccatcgtcattaacgtttccggcagctcattgatttggagcacgcggacgccctgactgcgcagcttgaccagcgcctcccgtttcgattcggccgtgacgacgccgtttttcttcccggcttttgtccttccctcgtacttaaatcgtggcattttggacaatctcctgtaaataaggttccgccgcttctttggaaatcgcgcccgctgcaagcaattccttcacatcggtttcaagcgtgtgcatcccgagtgcgcggctcgtctgcaggacattcacgatctggtgaactttctcattgcggatcagattggcaatggccgcgttgttgacgagcacttccgtggccgccctccgccctttgttgtcggctgtcggaaagaggcgctgcgaaataattccaactaaaacatttgccagctggatgcggatttgcgcctgctgggacggcggaaaaacgtcaatgattcggtcaatcgtcgacggcgcgcccgatgtgtgcagcgtaccgaggacaaggtgcccggtttccgctgccgtaatcgctgtatggatcgtttcgagatcgcgcatttccccgactaaaatcacgtccgggtcctgcctgagtgccgcgcgcaggccgttcgcaaagttttgcgtgtcaaacccgacttcacgctggtcaatgatgcatttttgatgtttatgtaaatactcaatcgggtcttcaagcgtaataatatgtttgtgcagcgttttgttcatatggtcgatcatggcggcgagcgtcgtcgactttccgcttccggtcggccctgttaccagcactaagccatgcggtttttccgtgaatgcatacaatacaggcggcaaatgcagttcttcaactgtcgggatcgtagtcgggacaacacggatcgccagcgacacgcagttgcgctgccggtacacattgatccggaaacgggatacgcccgggatgccgtaagaaaaatcaagctccccgcgttcctggaaaaccggccacatggtatcggaaatgatcgcttttgccattccttccgtcaattgcggcgtcatcacttcttttccgtaacgtttcagttggccgtttaaacgcagaatcggcggcacgccaacggataagtgaagatccgatgctttcagttcaaatgctgagcgaagcaagtattcaattttttccttcattcctttcacctactccggtagggcgacgcgcaacacttcttcggtcgttgtcagcccctgctttacctttagtaatccgtcatcgagcagaaaaatcgttttattttggatcgcatattcccttaatttggataaaggttccccgttcataatcccacgccggatgttttcattgatcatcagcagttcctggatcgccatccgtcctttgtatccggtcatgttgcagtttccgcatcctcggccgcgaatgattttctcaattttgatgccgcgttttttaaaaatttctatttcccgttttgtcggcacctgttcttctgcgcagtcgcggcacactttgcgaacgagccgctgcgacacgacgccactgagtgaggtggcaacgagaaacggctcaacgcccatgtctattaatcttgtaattgtgccgagcgcatcattggtatgcagcgtacttaagacaagatggccggtgagggaagcgcggatagcaatttcagccgtttccttgtcgcggatttccccgaccatgataatattcggatcctgccgcaaaatcgcgcgcagccctttgccgaacgtcatcccgaccgccggattgacctgaatttggttgacgccttcaatctggaactccaccgggtcttccaccgtaatgatattcacctgttcatcattgagatggtttagggccgcatataaagttgatgacttcccggaaccggtcggccctgtgatcaaaatgatgccattcgggcggtggatcaactgcgtaaaacgcttgagattcagtttgttgaaatcgagctggcggatatcgtggatggctgttgaaagatccaaaatccggagcacgattttttccccgaatacggttggcagcgtcgatacccggatatcaacgggatggaaatcgacgtcaattttaatacgcccgtcctgcgggatgcggtgttcggtaatatctagatttgccataattttaatgcgcgccacaagcacgctttgcatcgatttcggcagcacccgttccgtccgcaaaattccgtccacccggtaacggacgatgtattttgtttcctgcgggtccagatggatatcgcttgcccgcatttggacggcattttgcaaaagctggttgacgagctggacaacaggcgaatcttcttccccgggtgcggtttcggttgcctcttccttttcagcaatgccgtccagcagttcttccatattgtcatccaggtcgtaatacttatggattgcccgcaaaatatcgtctttggaggcaatcgccggttcaatccggaagccggtcgatagccgcaagtcatcgatcgcattaaaatccatcgggtccgccattgcgacaaacagtttatccccgtcttttttgagcggaatgagaagatttcgtttcgccatttctttcggcacaagattcatgatgctctggtcaaaaggatagcggaaaaggctgatgtgcgggatgccgagctggaattcgagcgcttcaatgagctgctgctcggtaatcagcccacgctgaagaagcgcatcgcccagtttttggcccgcccccttttccttcagcacctgttccagctgttctgctgtaattaatcctgcatccaccaataaatcgccaagcctttttcgcacttgcttcatccgaattcccccgctttatctgtcatgtcccgggtctttattatgtcagcttttgctgtctgccccgttatccttgccgtcatgcgtgccggtgctgtctttgctgtcatttgaagtctcagcttttgtgctggtagagttttcgcgatcctttgaagtctcagcttttgtactggtacttttttcgctcttttttgaagcctctgtaccggcactttttttgctttttgaagtctctttgccggcacttttttcgctgccttttgaactgctgccacttgttgacgtgtccgtttcatgaccagaaccgttatctgtttccgatgagtcctccgtattttccacttgtgccggattgccttttgcaacgatttgtgccactggcggataaaaatcttccgccaacagcacggatttcagcaggccgtgattctggctgtaaatattgcggaataccttggcataataacccgcttttccggcttgcaagacaacagactgatccgcttttaaagcaggatgatattgcacggttgtttcggggccaatcgttttttgatctttcagcaccattttatagttttcgagaaaaggccggcctgccacagatacggaaaaagcgccgtttcgaaccgtgaatttcaactgataagcggttgggttcgggttgacaaaagagaaatccagcttgcctttcaccacttttgcttcttttccaagcgttgcatagtacggcagttcgtttcccgtattgcgttcaatgatttcgaaattggtcggcagcaccgccccgtatatggcggttgcaatcatgctgagtgcttcatttgaaaacgaagcgcctgttttttccgctgttttgaataaggaaaacatcccgtgcgcaggaatgttgacttgcggaaactgctttgcccaattttcgagttctgttgcttccgcaagcgaaacatttgctactgaaccttttgatactgtcgtttctttttcgttcccatccagggcataaccggacaaatcaaaggaaagattggcggtctcaagccgggcggcggcgtggcatatggccatgtcgagccgggcaatatccacgtcatccgggctgacgtcgggaaaagactttgagaccaggtcccgaagcccgttatggtcaagcgtgacaacaagcgatgaggcctccccgttttttacccgaagcatgctttctgtgactgaaaaatgcagctgttcagccggaagcttcaccgtttttgccaaatagacgatttctaccggattggacgccttccatttctgaacggcagctgataatttttgctgtgcctgctcttccgtcagccccgacagctgtattcctccggctgcagtgccctgcgcatatttttctttatggccgaatccgttcgcaatggtcaaagccccaaaatgtgagaaactgaatataaatgctgtgctgatcaataagatggtaaaaacttttaaaaaccgcttgtttcccacacttcagcgccgcctttcattcatcaacatgcatggacaattcgacaaaaacacccggaccggcctcctgtgcccgcttaatgtcttcttcagacaaaaccgttcctgccgcgataacctgttccccgtttcccgcgtaaatgtcttttaccgctttctttccttttaaaagttccacttgttttgcccggagcgcctccattccctcttcgcccggttgttcaagctcttcctctacttcttttgtcagcagtttttcaggatcgtcaagaaaatggccgggtgcctcctctttcacaacaacaatatctctcccgtacgtcataataaaatcagcagaaaggatcgtttccgactcgcctgtttgcaaaacaatccctaaaattttgcccgtattttcatctgcgtaaaattcttttatttcgccaaccagctcccctttccgcgtcatcactttagccccgacaatgcggatttttttgttgacgagctggtctgcgatcggaatttcatttaaatcgatgacagccctgtcactttccacggtgaccgcatactcgccgattccgactacttttttgaacggaattgcttttacagttacttgccagtcttcgtgttcgatcgttaaaaaatcgacggatcctttgtccgggttaatgacaaaagattttacttttccaatttcagcgccttcagaaatgctgatgatcggctggcccaaaatttgcgtgctttttttcatctacctcacacctgtttcttcatggattattgaccgtattttgtccttaaaaaatcgatttcttcgcggatgactgggtattccgcataggtttccgccaagtctttcagcagggcttgcagcttgccaaattgttgttcagctatgtaatgttcgatcagaaggcttgcaaaggtgaaataatcttccggtgcaagctgcgggtgcaaatgcgccttcactagctgttcgtacgcgtcagccggctgcgtaaggcggtaaaggttcagttgttccactagcaccccaagcaattgcttttgaataggcgtcgtcccggttggcacggatgctaaagtgtccgatgcttcctcaacggcagggttgcctgccaattccgcttcgtttgcggcaacggtttcgcccgtacttgcgccgttttcatcttgttgttcccgtccctggcccgcttccgaatagaacttttcgggctctgccgcctggccggtttccttgtcaggcatcacgtcgatttcttctagttcgtctctgtcctcacctttcgcgccgccaactgtttcattttccgcatgcagtttttcaagttgcccggcatcatggaaaggaatcacatcaatttcttcccccttagacccgccggctgctttatcctctgcatccagatccaaatttacgacttgttcagttgggttagtttcttggacaggcgccaaactgatttcttccagctcgtctctgtcttcacctttcagaccgcgaactgtttcattttccgtctctgatggcagcttttcgcgttgcccggcattgtcggtttcgcggaaaggaatcacatcgatttcttccagttcgtccatggcaggcatgtctgtcccggaaagttcaacaggtgcttctgttttcttttcaaaagaaaggagcgggatctcttcttgttcaacatattgaacatcttcagaacctgatgacgttaccggtccttcttctgcaatcacttcggaatcttgacctatggttgtcccgtccaaaggttcggcatccgggctctccgcttccgccacccattcttcaacttcgtacatttccggcaaatgatccgccttattttcttcatttgcttcttcaagcagttccagacggttttcaagaaaatcaatttcttcttccccggagcgttctgccgcctgttcgtttgccggaagagcggtttccgtttcgtttccggccgcagcatcccccagttcttcccattcgggtgcatccttttcttcccgttttggcagtgtcccttctatttcaggtcccggcccgttttgctccggcaaaatctcttccgtttgaggaaccggagcacttttttcagccggaagaacagcggcatttacgtcaggcgagaccagtgctgccggccgatttccccgtgcaaccgccatctcttcctgctcatcccatactggaaattcgtctgcatcgttatcctgtccagcgaacaaaaatgccaactttttttcgaacagataggccacacaaattacgagcaaaaaagtaattaaaccactctcccatagcggaaccacactgcccgccaaaatgccgaaaagcgccagcaaaaaagcggtgccggccagcacaaccaccccttttttggaaaagccgaaagaaaaaaagacaaaaaatgccattacgcataaaaatccaattacggcaaacgccgcagtgagaagatccatcatcccacctctgtttctatcagagtacaaaattcccagaaaaaccaattatcgaaaatcaactaagactattttattataaatctcggcgaatgggaagattgtactgcatctttttacctgtctcttactggactgatgtattgatttctttcaaagtcactttattcactgtcgggatccctttcggcgggtttaaaatcatatcttttttaaaattaacggtgagtctggactttgcaggatccgcaggctggggatattggaatttcaaaattagcccattttctgtccagccccttgatgcacttaaaccaatcgtattcccatagatacccccattaattttcaaatttgatccgatgccatatataaacaagtcacgatttgagtagagataagcatcaatcacttttggacggtcttcatacaaattattgttggccaacttaatatttccatcacaaagtaaaataagcgtgccactactgttcgagaaattttcgacatctgcgtctcctcgtacataaatgctgccgtttgtattgacatccccgctgctcgtaagggacccattgacatacatcaccccgtttaaattcaatgctgaaacctcactcaatgtcgcattcccggcaatataaatatactgattttcgcctgtcgacagcactccgtttaaattagcgccaccgcctacataaatcttgccttttactgttaaattccctcttactatcaaatcatgatttacatacagatccccatttacaatcaagcttttgtttgcccaaacggttaaatcattgccgacgtacaagtttccttttattggttgactgccaacctggctgggtgttacatcatagccaaaagcgttcccatacttatctatattataagaatcgtaagaatttatttttaaatttcccggccatcccagcgccttggctgtaatcatatcgcctacatttattttgtcaaccgttaactgacgatttttcacaaccggggcaacagaaaagtagcggctgaagctttcaggtccaaatggcttccatgaatcaaatgttcttgccggatgctgatcggcctcaaaatatcttcccttcactgttaacgtcccattgattgctggatagtaagttcgtatatattgcgtgaaccctaaccaatcaacatatttcccgtagtttgaaacatacagatcccccccgatattcacatctccaataatataaggagacccgtacaaatacatattcgacggcgtcacggctgtatattgaaaaacgtccgagacagtggaaagcgtcatcacctttgttaacgtttttccagactttccgattggcactgttatggtgactttgcccaaaacaattccgtctggtgctgtcccgtctttcaatgttttatatgcgatgctgcatttgccgtttttctgttgctgtatgctcgttatggctgcctgaagcatgctgatcagctggcttggcatgacagtaccgttcgcaatggtactattgatgctgtcaacttgtttctcaattaaagcagtcgcttcatccgctaccatttccgcatttaatttatcctgtgtgcccgtttcagatacttttactgttttaaaagtactgacggatgcggatacgagtgaaacggtgataatcgccgcgactgcgaaaatgagaaggacggtcacaagcgtatatcccttctcttctcttaaaacatgcatcatggattcccctcttcgcccagtttataagcggcatagatctttttctcgaaatgattttgcgtgtctttcattacaaaatggcatatcaggctaccattctcagccgtaaaagttgtcccgtcaagtgaaattccatcgctgtttacaatcgtgccccctactgacaagttcccatctgatacagcgattgtcttgtcagttgaactttcctggtaggtgccgtcacttccaacatttatattgacatccactgctttgaaacgggtaaaagtcccgtcatcattttcgtcatcaggttcaatgtcgtccacattttccattgcgctgttcatgtattgtaaaatagccgtttgttctttgacaaaatttttacgtgccatgtcgcttttggattgggtgatcaccgtatttaaaacggcataaatgaccccgatgatcataaatgaaatggtaacagccgccagtaattctactaaagtgagccctttttcattccggcatttcatcttttcacataccctttcacttcaaccggttttagatgatttccactgtcgacttttactttgaccagcaggaggcggtcagaaagggaagaatccgccggaagggaaacggacacatatgccttataaccggaaatttccgcagcgctatcaagccctaaaaccgattgaatatcagcttgttgtgtggtgttcgccatttgctgcacttcattaaagttttttttctggtaagctcttaatatcccggttgcaatttgcaatgcagacagcgagtcatccgctttctttgtcacgcccgcattattggccaaaatggaacccactgtgagcatcacaatcgctaaaatcgtaatcgaagcgagcacttcgacaagtgtaaatccccggttgtttttaaaaaggggttttttcataacaacctccgctaagcattttgtcctgcgtcttatttcctataaaacttattttatcaaaaagcgccgggaaagtaattcaacaaatagaacaaataaaaaaaagggcagaactttttcagctctgcccgttcctttctgattggcccaaaatgtatttccggactttcgaaataaagtataaagaccccgtaatgactaaaacatctcttgagcctttcatttcttttattttagcaagtacggtttctttccaatcctccgaaaatgatttattttgatgatggcttatcttatacaacatctctgccggaatcgctcttggaaaatcaaaagttgtgaaaatgatttcgtctgttttgtggtcgagtttcggaatcatgtgatccaagtctttgtcgccaagtgcggaaaaaatcatgtgaatgtttttcccgcgcagatgggtgtccattgtttcgatcaggctgtcaatgccttccgggttgtgggcgccatcgatgataacgagcgggtcatccagcagtttttcaaatcggccgatccacttgctgaggagaaggcctttttccagtgcatgctgcgggatgcgaaaatggtggatatgtcttaacagttctgcccccataacggcaagcgcggcattgtaaatctgatggcgccccatcatggcgatcgacaagcagtcataggcgccgtacggagaagcaaagcggaaatgttcaccagttagatccccaccaatctccgcaaaagaaaattcctttccggcacggaaaagcggtgccttttcttttgccgctttttcttcaatcaccgctagcgcatcaggcagcattgctgtcgttgcaaccggcaccccgtgtttgatgatgcccgctttttcaaatgcgatctccgcaatcgtatggccaagcacattcatatggtcatggccgatattggtaatcaggctgacaagcggtgtgatgacgttggtggagtcaagcctgccgccaaggccgacttcataaataacgatatccaccggccggatgtcggcaaaatacacaagcgacatcgctgtaatgacttcaaactctgtcggtgcgccgaatgctgtgtgctccagttcttctgcaagcgggcggatctcgtttgtaagccggatgaggtctgcatctgacaccggcgttccgtttatgctgatcctttcgttaaactgctcaatatacggggaagtaaaggtgccgaccgtatagcctgcctgctctaaaatattccgcaaaaaggtgacggtcgaccctttgccgttcgtcccggccacgtgaaccgtccggattttttgttccgggtggtgcaatttttccatcagccactgcatccgctcaagccctggtttcatcccgaatttcgagcgggaccggatccagccgaccgcttcttcataggtttcaaacatatgcctttcctcccgtatgcaaggaagacgaatccgtaaagaattcgccttccacccttgtattactggttttcaagttctttgatgcgcgcttcgacggtgcttcgtttttcaagatagtctttttcttttgcccgttcttcggcaacgacattttccggcgcttttttcaggaacccttgattggacagttttttctggacgcgttcgacttctttattccatttcgccaactctttccggagccgggccagttcttcttcaaaattaatgagtccttcaagcggcaggaacagttcgacgccggaaacgactgcagtcatggctttgtccggtgcctcgaggtcaagccccattttcaattcatccgggttgcagaaacgggtaatgtacgcttcgtttcgttttaaagccgctaagaccgtttcgtctttcgctttcaaatgcagtttgatttttttgcttaacggcgtattcacttccgcgcggatattgcggacggaacggatgatgtcgacaagcagtttcatttcttcgctagccgctgcatctgtaaggctttcgtccacttccggccacgcggctgttgtgatcgattccccctgatgcggaaggttttgccaaatttcctcggtaataaacggcatgaacgggtgcaaaagccgcatcgtattgtcgagcacatacgcaaggaccgagcgtgtcgttttcttcgctgcttcatcttcgctgtagagcggcagttttgccatttcgatgtaccagtcgcagaaatcgtcccagataaaattgtaaagtgcgcgcccagcttcgccaaattcgtatttgtccgccagttttgtaacggtttcgatcgtttcgttcaaacgcgttaaaatccatttgtcagcgactgatttttcaccggacagatccatttcttcgtatttcagcccgttcatgttcatgagtgcaaaacgggaggcgttccaaattttattggcgaaattccagaccgcttcaactttttcgtaactgaaacgcaaatcctggcccggtgcgctaccggtggtaaggaaatagcggagcgagtccgcgccgtatttgtcgatgacttccatcgggtcgacaccgttgccgagcgatttgctcattttccgcccctgctcgtcgcggacaaggccgtggatcagaacatctttgaacgggcgcttgccggtaaacgcaagcccctggaaaatcatccgcgatacccagaagaaaatgatgtcatagccggtcacaagcgtatcggtcggataataacgcttgtagtctttagcttcttcatccggccagcccattgtcgaaaacggccagagcgccgagctgaaccacgtatcgagcacgtccggatcctgttcccagttttcaatatcgcggggcggctcagtgtcaacatacacttcgccggtttctttatggtaccaggccggaatccggtggccccaccagagctggcgcgaaatgcaccagtcgcggatattttccatccagtgcaagtatgttttttcgaagcgttccggcacaaaatggacttttccttccgacgcctgcagttttaccgcggcatcagcgagcggctgcattttcacaaaccattgcgtcgacaaatacggttcgacaaccgcgccgctccgttcggaatggccgaccgaatgaagatggtcttccactttgacaagaacgccaagtgctttcaagtcctccacaatctgtttgcggcattcaaaccggtccatgcctttatattttccggcattttcattcattgtgccatcctcgttcatcacaaggatacgttcgaggttgtggcggttcccgacttcgaagtcgttcgggtcatgggccggcgtaatttttacggcaccagaaccaaatgtcatgtccacatactcgtctgcgataatcggaatttcgcggccgacgatcggcaatacaatcgttttcccgattaattgtttgtatcgttcatcatccggatggacagcgaccgccgtatcaccgagcatcgtttccgggcgcgttgtcgcgatttcgatcgtgccggaaccgtcgcttaacgggtatgccagatggtaaaatgcgccctgcacctctttgtagacgacttcaatatcggaaagtgccgttttcgtttccggatcccagttgatgatatactcgccacggtaaatcaagccttttttataaagcgaaacaaatacttcttttacagcttttgacagcccttcatcgagcgtaaaacgttcgcgcgaataatcgagcccgaggccaagttttgcccattgtttgcggataaattgagcgtattccgctttccatttccatgcttcttccataaatttttcgcggccgagatcatagcgggatttgccttcttcacgcagtttggcttccacctttgcctgtgttgcaatcccggcgtggtccatccccggcagccagagcacatcatagccttgcatccgtttcatccgggttaaaatatcctgtaaagccgtatcccaggcatggccgaggtggagcttcccggttacgttcggcggcggaatcacaatcgtgtacggtttcttttccggatcgccttttgcttcgaaaaatttgccgttcacccaccattcatagcgccctttttcaacagcctgcggatcatatttggtcggcatgctgatgtcctgctgttccatttgcatcattcctttctgcgtcttttacggataaacacaaaaactcccttcgtcataaaaggacgaaaggagtctgttcgcggtaccaccttttttcacgggcaaacggatgcccggcactctcgggtcagtaacggcacttcgccggcttttgctactttcggtttcacaaaagctactcccgggcgaccttccagcctgtttcgcataggaaatctttcagcagctgatttccctctctgcatggaaacaaaatctgtactcttcccgttcattgtactttgatttttgaaattgactatagtttatggtatcggtttttgtgaaaatcgtcaatagcattgcccatttttagaaaaaatatgcggcggatgcactgatccgcccgcttttcatacattatttttgagggataggtggatgatgatgaagaaaaaaattgacaaacaggccgtccgtacatgggcgcggaatgcaaaaaaagtgtgcaagcagctgattcttccgttctccgtctttcaggccatccgtacgattatttttccgacgacgtttgacgttttgctgcttgccatatttattctcatttatctcgggtttcagtatgaatggttttagtggccgttcctgcttttcatgacgcgggggcggccccttgtgacaactgcatgacgacatactcggtatttttcattcgccagtacttttcctgcagtttcgcgactgctctcgcttcatggcgttttccttcatttgcaaagtattcctccacggtttggatgatcggtgcgggataagcgagatagctgaaaaataagcttttttcatcttctttcagcggaaaatagctgaaataggtcttcacccaatccacgcagtcgtcaaaccggctcggataggaatcgagcgtccgcgacaagaagggaagcaagtcataaaaaggcgcagcgtttttcgccagttcgaaattggtaaagtacccgagcccgcgttcatcgtacaaaaaatgctccgttgaaatttttccgtggatggtcaccgttctcgctttctccatctcttttgattgttcataccagttttccagctgccggatcgaaaatttgagcgcctggttcgtttcattgtaaaaggtgcagtacaacagggcaaacggggacatatagacctgctcttcacaccgttcaaggaactcttccaaaaaatcctgctgcccgtaccagcgggaaagggtttcttcatagtattcccgccgtttttctattgagatctccgtatctttgacggacaagctgtgcaggcgtgcgagttccctgaacattttttgatgtttctcgccgcgtgcttctttttcttcgtttggcagccagggcattaaatagtataatgccccgttatacagcaccccgtaacggccgtccaacgcgggatagaccgggacaatacggttgtatccccgctggtacagagactggacatgccggataaatcccatcccgttttgcggtgcaattttttttaaagcaaagatgccctggccggtataaattttatacacttttccgtaccgcccgacatattcagcgttcaggccgtaatgctttacaatccgattgatgtcctgctgcgaaaggtcagtcacccgtttcaccttcttagagcgcttctcctgaaaaataggcgcttgctcattttcattcccccgctgcgccgcattcgccgcggcttgaacataggcgcaatctaggttaagaatagctcgttttgcacgcttccttacgcaggcgcttagcccctgaatttcagatgcatccttcacctagacgcccgtgcctgtgaatgctccggctcagtgatttttttcggcgcgcgcgtttgcgggaacgtacagcacttgcccctcatatacatcctggttcacttccaaatggttcatccttaaaatctgctggacattgatattgtatttttcagcaagctggtcgagcgtctccccgctttggacgatgcaaacctttaacttggcaggcttttcttcatctctccgggcaaaaaagtcggcaagcgaaatagattcgtatttttgcttctttttcttcttggcagccgaatccttttcttccggcacttcctctattttctccccgctttccggcgactcttccacaatcgtttcgctgctcgccacagaagaagattcatctttttcaggcgattcttgcttgagataagcagaagattcatcttccattgccttgctctcgatccggaaaacgggctccgtcttcccggcgtcatccggctcaagagattcttcgttcagagccgttttgctctccgtccggaacgcggatgcggtttttccggacaattcctgttcaggatgcccttcatcccgcactgggtcggcctgccattcgttccgcaccggtacgctttccgctatggatgcagactcgtttttgcctgaaaactccggttctgcatgccattcgttctgcaccactccgctctccgccaatgatgcggattcgtttttgccggcaaaccccggttcagcgtgccattcatcccgcaccggttcgctctccgccaatgatgcagactcatttttgcctgaaagatccgcttcagcatgccattcgttctgcaccactccgctctccgccaacgatgcagactcattttttcctggaaactccggcccaggatgccactcattctgtaccagttcgctttctgccaacgatgcagactcattttttccggaaaactccggttccgcatgccattcatcccgtaccggcgcggctgtttccgcctgccatgaagcactttccggcacttttccgcctgcttccggcaagagactctcctcttcttcttccggcagttcgaccggtgctagcacattcagttcgtttgtgtacggttccggctgagcaaccgattcttccggcaccacgcgcgattcgatcgtaaaaggtgtatacaattccgggtcagcgtgagattcatcctcttcttctttttcctcatctgcacgcaaaggcacttcttcaaagctttccgcttcttccataaaatggcggggcggttcggtgctctcttcttcttgttccgataaactccactcggaatggctaaaaggcgcctgatatgctgcgtccggctcatccaaataggtttcccggccgttcaaatccgggtatggtgctgtttcggcttcgtcctcttcctcatccccgtcttgcaatattccctcaatcgcaatatccgcattgatttttaaacaatcggttccgtgaaattgatagtcaaatccttctatattgacgtccagttcctcaatatccgcaattcttgtcttcggaatggtaacgtctaccgggaaagattggtaaaattcaaatatgccgtcttcttcccggtactggaccgcctgcacatacttcctgaacagcacatcttccccttcttcttccccgcaaccgatatactccccggccaaatagagattgcctttgatcacgacatactgctccaattcctgtatggtgatatggggatccaatgatattgataaaagttcttcaacttcctgtccttttttaaaccaaatcaattcttctaatgaaaatcgtatggacgattgattttgcggcaaagcgggttcctcccttcaattcctccaaatcccaatgaatatgtcatttacactgtatgaagcaatcggggtttttatgatcgcaaataaaccgcagcatccgtaaatcacttgaatggctttttcgcaacaatattggacggggagagaaatcgataaaaaccggctcatctgttttcaggttacccgttcaaaaacttagatttggtcgagctaggcgaactgattcggccatccgttttcggagtgatccgttcaaaaaccatcgggccacccacagagcgtgaaattttccctactgctacttctctctcgcccgcagcggacagaacgcaaaaaaaaccggctcatccatttttggacttgccggttcatagccgcaggattacccgcggattgccttaaatgttttttctgctgcttcaacggtacggtcaatatcctcgtccgtatgcgcggcggacaagaagatgccttcgaattgggacggcgggaggaaaatgccgttttccgccatgccgcggtagtagcgggcaaacagatccaaatccgaagtgcttgctgatgcaaaattattgacttcttcattggtgaaaaagatgccaatcatcgatcctgcccggttaatggtatgcgggatatcgtatttcaccgctgcctcatgaaaaccttgttcgaggcggtcggcttttcgcctgaattccgcatacgtttcaggtgttaactgccgcaatgtttcatatccggccgtcatcgcaagcggattgccggacaaagttcctgcctggtaaacagggccggtcggtgcgattttttccataatgtcggcccgtccgccaaatgcgccgacaggaaggccgccgccgattactttgccgaggcaggtcaaatcaggcgttacatcaaagtagccttgtgcacagtgatagtcgacacggaaaccggtcatcacttcatcaaagatcaggagggcgccgtatgctgatgtgacttcgcgcaacccttgcaaaaagccgggcttcggcggaacaacgcccatattgccggcaaccggttcgacgatgatgcaggcaatatcttctccgtactgctcgaatgccgatcggacggcttccagatcattgtacgggacggcaatggtattttgcgcgattccgagtggcacgccggggctatccggcagaccgagtgtggcaacgcccgaccctgctttgatcaggagcgaatcgccatggccgtggtagctgccttcgaattttaaaattttattccggcctgtataacctcttgctaggcgcagagcactcattgtggcttccgtgccggatgagaccatgcggacgatttcaatcgacggtacgcgttctttcacgagtgacgccagtttattttccatgatcgtcggcgtgccgaaactcgtccctttttcggccgtttttttcagcgcatccacgaccccaggattggcatggccaaggatgagcggcccccatgacagcacgtaatcaatatattcgtttccgtcaatatcataaatttttgcgcctttgccgtggtccataaaaatcgggttcatgccgaccgctttaaaggcacggacagggctgttcaccccgcccggcattaatgtgaccgcttctttgtatgcttcgattgaattttcatatgagcgcatctttcaacctcccgtttattccgcaagccagcgagcaatatcgagtgaaaaataggtaatgatgagatcgcagccggcacgcttcatgcttgtgatcatttcaagaacaatcgccttttcatcaatccagccgttttgtgcggcgccttttaccatggaatactccccgctcacattatacccgacaaccgggaggcggaattcattgcgcacatcacggacgatatcaagataagaaagcgtcggttttacgattagaaaatctgccccttcttccacatccgactgtgcttcacgcaatgcttcgagccggttggccggatccatctggtacgttttccggtccccgaaagcgggtgtgctgtcagcagcttcgcggaacggaccgtaaaacgcggatgcatatttgaccgcataactcatgatcggcacatcttcaaagcctgcttcatcaagccctttgcgaatcgcggtgacaaacccgtccatcatattcgaaggagcaatgatatcagcgcctgcttttgcctggctgaccgccgttttcgcaagcaggtcaaggcttgggtcgtttaaaattttcccatcttccacaacgccgcaatggccgtgatcagtgtactcgcacaggcaggtatccgcgatcacaatgatatccgggtaatttttcttgatgaaacggatggcttcctgaacgatgccgtgatcgtggtacgcttccgttccggttgcatctttatggttcggtacgccgaataaaatgacggatttaatgccaagggaaacgacttcatccatgatttcatggagccggtccagcgaccagtgatacacacccggcatcgaagcaatttcatttttaatattttcgccttcaactgcaaaaatcggataaatcaagtcgttcactgttaaattcgtttcgcgcaccaaagcccgcatattggcactttggcgaagtctacggtgacgggcaaactgtaaatctttcattttatttcctcctaaactggtagaatgccgcaatgtattgcatatttatccgggaagtatgcacagctgccggcttgttgggaatgattgcgacggtcgcgggcaaatcccgctttttctattttgttttcttcgtgtcgaacatcgcccggctggtaatctctcggagaaaaccgtacatggcagccggtttgttaggccggccgcttcaatcccgggttcgtgccggtttctatctatttttcttctaaacggacaaaatcgcataatgccccaagcatggcctcgacggtgtattcatccgggcaaaccgctgcacggctgccggctttttccactgcctgcctggttgaagggccgatgactgcgatccgggttgaaagcccagcgatatccatgccgctttcttcaagcgcgcctttaaaatggcggaaggcggacgggcttaaaaacagagcaaaatcgatgtgctcccgcccgagcaaacgggtaagcttttcttttgccccctccggcatatacgtctcatagacaatccattcctctgctattataccgctttttcttagaaaatccgcaatttctgtcccggccaagtttcctttcaggagaaggacgcggcttgcccggtgtccgctccgcaaaaattcccgggcaaaatcttttgccgtaaacttccggggcgcaaaagaaacctttaaaccggactgttccatacaggcagccgtcttttttcccacagctgcccagtttatgttcaaatgctcacatgctatacccgcacggctgcatgcttccaaaaaataacggaccccgtttttgcttgtaaacacaacccagtcgtatgccgagagttttcgcaaaaatacagatgcggacaggtcggcatatgcacggaaggaaaccatcgggacgacaaaaggggtgccgccgagcgcttcaatttgtgcggcgagcttttcgccgtcttttccgcctcttgtgatcaggatatttttcccgcttaaaggcccatttgccgtcatgactgcccgagctccgctttcacttgttcaatcagcgcctttgccccttgccggcttaaaatatctgccgccttttctccggccgttaccgggttgtgggagacaaccgtttctttatataccgttttgccatcaggggaagcgacaagggcagtgagggaaatgccttctgccgttttcttcgcaaggccggcaatcggtacctggcagccgccttccattttatcaaggaagacgcgctccgcctttaccgtttccgccgtttctgcgctgtcgagcttccggagcgcatcgagcagttccccgtcatcggcgcggcattcgacagcgagcgcgccctgcccgattgcaggcaggcaaatatccggatcaaaaaattcggtgacggtatccgcactccagcccatccgttttaaaccggctgccgcgaggacgatcgcatcgtaatccccgttttttaatttttccagccttgtatcaatattgccgcgaacagacttaatgcggatatcgcttcttacagcaagcagctgggcgccgcggcggaggctgcttgtcccgacaaccgccccttccttaaggctggaaaaaggggtgccgtttttggaaatcaaggcatcccggacatcttcacgttccggaatgcagccgatcacaagcccgtccggaagcacagccggcacgtccttcatgctatgtacagccatgtcaatttcatgattcaacatggcatcttcaatttctttcacaaacaggcctttcccgccgactttggacagggtgacatcgagcactttatcgccttttgtggtgatttccctgatttcaaaacgaaaaggcagtccgagctgttcaagcttcgccaccacccatttcgtctgcgtcagggcaagtttgctccgcctcgaccctacgacaattgttctcatccggcaatcctcctaataatacaaatgaaaatccgataatcctgtaattagaaaaaagttaatcaaaatgattaaaaaagcagccatattccaataagccagtgtttttccgaacatgtggcggcgttcgcccccatacaggagaaaactgtatacaagcagcacgacaaacgacccgacaattttcggatcaagccagtgaatggccggaagccgcaagtatgcccaccatagcccgagaatcagcccgagcaaaaggaccgggaccgcaatggcattcatccatttcgaaagccgctccagttttgcaaggtcattcaggcgccagattctgtggctccatttcttttccttcagccacttatattgtaataaatacagaacggaaaagacaaaggacagggaaaacagcacataagcaatcagcgtcatcgtaatatgcatgagcaaaagttccgataccattcttcctgccccttgtgagaccttctccggggcaaaagcgtggaccgtcatgataaaaaagccgatgacatttgtaaaaaacacggtaaagtcaacgcgcagcaggcggttcagggccagagacagcgtcagcaatgcccatgcataaaaataaagcccctcagacaatgtcaagaccgggaaccgtctggtgtgagccatgtacaaaataaatataaccgtctgcaatgcccagacaacggaaagaaaacggaaggcagccttgttagccttccggttccggtggagaaagtcaagaaaataaagcaaaatactggctgcataaagcaaaatcatgccttcatgcagtctgtccgtccatacggcatacattgccgggctccccggttaacccgaataggacgggcggactgcatgccgcgccatttcggctgccggttccgcttgtcccgtttctgtttctaaattaaaaatttggcggaacagttctagattccgggctgcatccggcgaacccgccatttcttttgcctgcagaatcggatctttcagcatctggttaataatgctttttgtatgtttgctgatgactttccgttcgcgttctgttaagtccggcagcttccgttcaatgcttttcatcgtttccgcctggatcgcgagcgctttttccctgagcgccgtgatcaccggcaccaccccgagtgtatggacccattcattgaatgcgcaaacggcatcggaaatcatgtccgcaatctgccgggcggctttttcgcgttctttcaagttggcttccacgatgccttccaggtcgtcaatatcatacaagaaaacggattcaagggacgcggcttccggatcaatatcgcgcggcacggcaatatcgacaagcagcagtgggcgcccgttccgtttcttttcaatgggttttaacttgtctgctgtaaggatgtacccttttgccgaagtggaggtaatcgcgatatccgcatccaaaagcgccgtttccaaagatgccagcccgagtgcctcgccatcgaagcgtgcggcaagaagcccggctttttccggcgtccggttgatgacggtaatccgggtggcaccgctgccgtgaatgttttccgcagccagttcgcccatcttgccggcgccgatgatgaccacttttttatcagccatatcgccaaaaattttcttcgcaagctccacagccgcataactgaccgaaacagcattggaagcaatttccgtttccgtatgggcttttttcgctagtgtgaccgcatctttgaacaggcggttaaaaatggtgccggttgaaccggatgcttgggccagcagaaaactgtccctcacctgcccgagaatttgcgtttcaccgagcaccatcgagtcaagcccgcaaatcactttaaacaaatgcgcaatggcttcgttgtcttcgtaaataaacagatagggggcaaatgcttccttatctattccgaaccattctgacagaaaatctttaatataataacgcccggtgtgtgcctggtcggcaaccgcataaatttccgtacgattgcatgtagacacgatgacattttccaaaatgctctttttcttttgcagcgccgccatcgcatccgcgagttccgcctcatcaaacgacagctgttcgcggatttcaaccggcgcagatttataatttaatccgacagtaagtattctcattgttgccctccggcacccccattttatcttgccaaatgcataggattgaatgttgatctatgttaagatgaatagaagaaaaaagctcgtttttctcttttgaaataataccattcctacctgtaaaatagcagaaacaggcgatggtttcaagcatctagattgaaggaaagaagtgtgtcccattgaaaagccgcaaaattttttccgcgattatcctgatcgggttcgggctgtatttttatttgcagcgttttgacctcaccggcatgaaggactactttacatggccgacgctgttgatcattgtcgggctcgcttttttaggcgaaggctactggggccgagacggggaatcaattttgccgggggtcattctcgtcgggttcggcctccacttccaccttgccggcaaaatcgccatttggccggataatatcggggtctttgttctcattattgccatcggctttttgctccgttcgcaaaaaaccggggacggcacgttttacgggctgttgtttctcgtgctatccatattgctcctgttttccgataaagtaatgggatggttcggccttgtcgaaaacaatgtttcttccctgatcaatttctggccggccgtgcttgtcgtaatcggcgtctacctgctgtttgcgaaaagaagggggcggaaataacacccgcccgtgcagtccggcatgaaaagccaagtacccaaacagccccgcgcgcccaaaaaaacaaccaggcgctcattaccggcattttccggggccggaccgctaaaaaatacgattttagatccggatcctgcagaaaagcccggtgcccgcatgctggccccgggctttattcacttaattctttccatcagggaagcccacactttgtcctttccctctcctgtttcagatgaaaataaaatgatttcgtcttctttttccagattcagcgtttcttttgctgttttcaaatgagatgcccatttgcctttcgggattttgtcagcttttgtggcaacgacgatacacgggattttatagtactttaaaaaattgtacatcaaacagtcatcgtttgtcggcggatgccggacatcgacaatgagcacgaccgtcttcagctgttttcttgacgtcatgtacgtctcaatcatccggccccatttttcccgttcttttttcgacaccttcgcaaacccgtagccgggaacgtcgacaaagtataatttgttttcgattttgtaaaagttcagcgtctgggttttccccggcttggaagaggttctggcaagggctttacggttgatcattttattgataaaggaagactttcccacatttgaccgtccggcaagcgcaatttccggcaaatgcccttccggatattgctcctgccgcaccgcgctgatgaccagttctgcctccgttactttcatttctcctcacctgcaatggcaatttcaatgacttcatccatatgcgtgaccgggtaaaaatggagatcaccgcgcacgctttccggaatgtcatccaaatctctctcattttctttcggaataataattttcttcagccccgctctatgtgcgccgagcgacttttccttcaatccgccgatcgggagtactctgccgcgcagggtgatttcgcctgtcatcccgacttccttatgcacggcatgcttcgtcagtgcggaaatcagggcggtcgcaatcgtgatcccggcagaagggccgtctttcggcacagcgccttccggaacgtggatatgaatatcatacttttcatggaaatcaggcgcaagcccgagtgcttccgctttggagcggacaaaactgaaggcggtctgagcggactctttcatcacatcaccgagttttccggtcaggaccagctttcctttccccggtgaaagcgacacttcgatctgaagcgtatcgccaccgacggtcgtgtaggcaagcccggtcgctacgccaatctggtcttccatctcggcctgcccgtaatggaaaagcggcttcccgagaaagtcaacgatattttttgctgagaccgtgacccgtttccttttccctgatactatgattttcgccgttttcctgcaaatttcggccaatctccgttccaggccgcgcacgcctgcttcgcgtgtatagcggcgcacgatcaggcggagggcttccgcatccatcctcagctgattgcgagcaagcccgttttcttttatttgcttagggagcagatgggtcttggcaatttcaattttttccaattccgtatatccggagatcgaaatgatttccatccggtcgcgcaaagggccgggaaccccagacagatcgttggccgttgcaataaacatcactttcgacaaatcatacggctcttcaataaaatggtcgctgaacgcatggttctgttccggatcgagcacctcaagcattgcggctgaggggtcgccgcgaaagtcgctggccattttatcgatttcatcgagcaaaaaaaccggatttatcgtgccggcttttttcatgccctggatgatccgccccggcatcgcgccgacatacgttctccggtggccacggatttccgattcgtcccttacaccgccgagcgaaacgcggacaaattttctgcccaaagattttgcgattgaccgtgccaggctcgttttcccgacacccggaggcccggcaaggcaaaggatcggccccttgatcgaccgggtcagctgctgcaccgccaagtattcaaggacgcgctcctttactttttcaaggccgtagtggtcttcgttcaaaatcttttccgctttcgcgacgttgagatcatcttctgtggcgttcgaccacgggagtgtgatgagccagtccaaatagttacggatcaccgcgctttcagacgaagcggccgggattttttcataccggtccaattctttgaatgcggaattgcccacatgctcgggcatgccggcatttaaaattttttcgcgcagctcatgcacttccgccgttttgccttctttatccccgagttctttctggatggctttcatttgttcccgcaaataatattctttttgcgtccgctccatcgactttttcacttgttggctgatttctttttcaagctgcaaaatttcctgttcatttttgatcagcccgatcagctttcgtattctttcttttatatcaatcgtttcgagaatgtcctgcttttgcggaaggcggagcggcaaatgggatgcgataatatcggccgccttgcccccgtcttccatatcggagaccgcctggaaggtttcacccgaaatttttttcgactggctgatgtactgatcgaaaaattcgagcatcgtgcgcatcaacgcttccgtttcagcatccggccgaaactgctcatcaaatgtttcgacttcgacggaataaaaggtgccttcatcttcaaaagagacgatttttgcgcgccgcacgccttccacgagcacccggatggtcccgttctgcagtttcatcatctggttcacttttgtgagcgttccggtttggtataaatcttcctgttttggttcttcgatggaaacgtctttttgtgtcgtcatgaaaacttcgctgccatgcatcatggcgttttcaagggcctggacagagtagtcccggccgacgtccaagtgcaaaaccatcgatggatacacaagaatcccccgtaaaggaagcaaaggaattgtgtatgcggattgtgttgtcatctcagcacccctatcttgatacgtcttttagggggcctgtccattaaccccctatgagcgcattgtcgttaaaatgtttctttaatgcgatatccaggacttcttccagctgccggaccggaacgatcgcaatgcctgtgatttccttgaacgtggcctgcatgttttcggcaggaatgatcaccgttttggctcctgcctgttttgctgcttttattttggcatacacgccgccgaccggtttgaccttgccgtgcaggctgatttcccctgtcatggctactgtctggtcaacaggaattttataaatggcggaataaatgccgcatgccatcgcaatcccggcggaagggccgtcaatcggaatcccgcccggaaaattgacatggaggtcatactggtcagcggggacacccatcgtccgtaaaacagtaatgacgttttcggcggaacctcttgccatgctttttctgcggaccgatttcccttcgccgccaatactctcttcgtccacaatcccggtaatgttgacgctgcccctttcttttgccggaatggccgctacttcaatttcaagcagcatccctgtgttcggaccggttacggcaagcccgttaacaagccctgcagccggctgttcaggggcctttttctcatagcgcggcgacaactggctggctgttgccacccattccaggtcctcctcccggataaaatcctgtccttcctggattgcaagccctgcagcaatttgcaccatattgaccgcttccctgccattttgcgtatattgcgccaaaatgtccagcccgttttcgctgattgccatatggattttatcagctgctttttttgcaacctgtttaatttcaccgcggtcaagttcgcgaaaaaacacttccatgcagcgcgaacggatggcagccggaatttctttcggcgttctggtcgttgcgccgatcagccggaaatctgcaggtagtccattttgaaaaatatcatggatatgatgtggaatttcccggttttcgggattgtaatacgcactttccaaaaaaactttcctgtcttctagtactttcaataatttattcatttggatcggatgcaattccccgatttcatcaataaacaagacgccgccgtgggcagaggtgaccgcaccctgtttcggctgcgggatgccggcctgccccatggcgcccgccccctggtagatcgggtcgtgcacggaaccgattaaaggatcggcaatgcccctctcatcaaagcgggctgttgtggcatccagttcaacaaaaacagcgtcacgttgaaaaggggatttcggattttttttagcttcctcaagcacaaggcgggccgctgccgttttgccgacaccgggcggcccgtaaatgatacagtgctgcgggtttgggccgcaaagtgccgcccgcagtgctttaatgccgtcttcctggcccacaatatccgcgaatgctgccgggcggacgcgttccgaaagcggcacagataaagaaatttcccgtagtttccgcaactgttccatttctttttttgattcgcggtctatcgtaattttttgtgttttttggctttttagcaagttccaaaagtaaagcccgataatgatcccgaaaaatagctggatcaataaggcaatccccgtccaattcatcctgttccctccaagcatttcagttgcagcctgatcatgccgcttccttatttacctagtatctccggctgccggagggaataaacggggatttctgaaaaccaggaacggctgggcggaagaaaaaagggcaagcgcaccgctcgcccattgcttctttattctgcttcgcctctcatttttccggcgctgtgccaataccaggaatttagccctgctgccttagaccggttcctgttcaaaaaagaatgttcacgccggattgccggcgggcagcccggctccgcttatttatgccgattttgtctggtcgctgccttcaatgactgtgccgtctttcagcacgagcctcgggaattctttgtccaggacggattcttttgtaacaatacatttttcaatatcttcccgggacggcaagtcaaacatgacatcgagcataatgccttcaataatggaacgcaagccgcgtgcacccgtttttctttcgatcgcttttttcgcgatttccttcagcgcatcctgttcaaattccaattctacatggtcgagttccagcatttttttatactgcttgaccagcgcatttttcggttcggtcaaaattttaatcaatgcctcttcatccaattgttccaaagtagcaatgaccggaaggcggccgatgaattccggaatcagcccgaaagaaagcaaatcttccggcagtacgtgcttcaggagcgattgttcatcgagttcgtcattttttaaatcggtgccgaaaccgatcacttttttgccgaggcggcgtttaatgatctggtcgatgccgtcaaacgcaccgccgcaaataaacagaatattggttgtgtcaatctggataaattcctggtgcggatgtttgcgccctccttgaggcggaacgctcgcaaccgtgccttccagaattttcaggagcgcctgctgcacgccttcgccggaaacatcgcgcgtaatcgaagggttttccgatttacgggcaattttatcaatctcatcaatgtagatgatacctttttccgctttttccacatcataatcagctgcttggatcagctttaacaaaatattttcgacgtcttccccgacatagccagcttccgtcaacgatgtggcatcggcaatcgcaaacggcacatttaaaatgcgtgccagcgtttgcgcaagcagcgttttcccgctccctgtcggcccgattaagcaaatattgctttttgccagttcgacttcatcgattttgctgttggaattaatccgtttataatggttataaacggcaaccgcaagcgattttttcgcctgttcctggccgatcacgtattccgcaagaatttcacggatttcatgcggcttcggaatgtctttgaattccacttcttcttctgtgccaaattcttcttcaacaatttccgtgcacaattcaatacattcatcacatatatacacacccggaccagcgaccaattttcgcacctggtcctgcgattttccgcagaaagaacattttaactgctgtttttcatcgctgaatttgaacattccattcaccccttatattgtacttcttccattccattggcagttcccgaaataacagggacccttcatgactcccgcttaccattatacaaaccccttttgctgtgatttgtatatggattgtatcacaaaacgatgccggcaggaaataaactgcttataccattctccatgcatatgtaaaattcctgtctactccagattttcccaaaaaccagacgaatatgcttctccatcctgaaaaattgcatcggctaagtttctggtgcgcttatcttacagtatgggcttctatgtattttttggcacagcccgcaggttagaaaacaagacacgagccagtgccgtgccttgtatttctatttatattatgcaacagttttgctgttttgcacaagaaaatcgatcgctttgcgcgctttcagatcggctttaatgccgtccgtagaaccgagcacccgcctgatatcgtcaacggacatgccgtacatttcggacatgcgcttcagttcttcatccacttcttcatcggatacttcaaggttttccgcattggcaatcgcttcaagcgtcagattaaagcggacgcgtttttccgcatcttctttcatctgattgcggagcgcttcttcattctggccggagaactgatagtaaagttcgaggttcagcccctgggcactcaagttttgttcgaattcttgcagcatgcggtttaattccgtattgatcatcgcttctggaatgtccatttctgcattttccgcagctttttcgaccactgcatcttcaaccgcgtgttttgctgcatgttctttcgattcttttaaatctttttggattttttcttttaatgcatccagcgtttccacttcgtcatccgcatcctgcgcgaattcatcgtccagttcaggcaggtgtttcgctttgatttcatggactttcaccttgaaagtagcttttttgcctgcaagttcactagcgtggtattcttccgggaaagtaacttcaatttctttttcatcgccggtttttacgcctgctaattgttcttcaaaacctgggataaagttgcccgaaccaagttcaagcgaatagttttccgcagatccgccttcaaacgcttcgccgtcaacgaatccttcgaagtcgatgacaaccgtgtcgcccatttccgcttcgccgtcttctttgatcacgagttcggcaaggcgttcctgcaatttcttcaattcttcttccacgtcttcgtccgttacgtctgtatccggtttttcgacttcaaggcctttgtattcgccaagtttcacttccggtttcacggtaacagtcgctttaaagattagcggtttacctttttccatttgttcgacatcgatattcggcgtatcaaccggttcaataccggtttcttcgatcgctttttcgtattcgccaggcacgatcatatccagtgcatcctggtaaagagattctacaccgaaacgtttttcaaataaaggacgcgggattttgcccttccggaaacccgggacattgatttgtttcactacttttttgaaggctttatccagacttttatcaaccgtttcagcatctacttcaactgtcaggatcccctggtttccttcagttttttcccattttgctgacatacctttccctccaacaatctataaataataatgtaataagtaggaaatagaccgggtctgtttcctgattcccttgtctattgcttttttcaaatacggattgaaaaaagacagtttacaaccatttaattataacatagcttttttgtctttcaatgatgagcctacagattcggcaaagaaatttcctcaaggctttcgagatagcggacggcctcaagtaaggtatccggctccaccgaatagtacatcgcgattttatcaaaatacgcttcctgcccgaaaagcttcaggcccatgctgtagtaggcagccgtccacagcgcgggatcttccggctccagttcaaacgggtacagcaggaaaaaatgccggtccaaaaccgttttaatctgagcaaaaagggtcggatttttttgttcgacatcccttgaaagccgtgtaatcaaaagattgtacagctgcgtttcaaaaatcggcaaaagatgcgcgggatttacggcgccagccttgccgagtttttgcatctcgaattcatccgtgatcccctgttcttttaaaacgttcagcaaaagggtctggataaacggatgtttgtccggatcccggatatatgcccggatttcatcgagatacggccggatattttcatgcacaagatgcgaaacccgcaagatttgttcttcctggtccccggtttcaaaaagcttacggcccgtatgctcgggctcccgttctggttttggcatttgcatccgcttttcactgaaagcgagcagtttttcataatgatccagcttgtccggtggggcttctttttcttccagcagagcgcgcaaggtactgctgatttcttcatgttcaccgagctggacaagaatcatgagaaacagatcgaggatttcgaagtagtcaccgtttccttcacgaagcatttgtctgccttgttctttcgccccttcataatcgccggcttcatagagcgcaatcatgtaggcggtcccgatttccccatcgtcatggtcaagccggcgtgcctggcgaagcagcgcggcagcttctttatattctttttggctgatggattcgagtccccgctccaagaggcgttctttcagacgggggaacggcaccacattgctttttccgtttttcattgtccattccgcctttttttagatcgtcactagtgtagcatgaaccggtttttttgcaaagggtttatactgccagggggctttctattatgaaaaaagccaaacacagaaagccataaagcttccgtgtccggcttgcttatttcttgtccggtctgatatcgtgaatgtcctcttcctcagccatttccgtgccataagcaaggcgttgattttgcctttttgccgtgttttcagcgcttggggcatcatgatgcaaaaacctgtgcacgagcacttccgcagccgaaatcaggcaggcggcaatgaagctgccccatgcaatttgcaaataattgtcaagcacgacgttcccgaaaatccagacactggcataaacaagcaaaaaatcaacaacggttgctttccaattcccaatgcgtggcaaaaggagcacatccccgacaacataagacacgattgtgacaagcaggctgaacgataaaatatctgtgatcgtcgcatcgaaaaagaggtcaagcgcaaccgcaaaagcgacaatgcacgtgataaattttgccagtaaaacgattgcatttcgcatttcaattcctcccttaaacaggcagttttacttatagtttgtccaaatgaaaaaggattgaaacatgatgggatgatttaaaagaagaaaaaaggggtaatgaataacaagtctacacatgacggagggattcgatgaaaaggtcaatgatgaatctgatttcaggcactttgctttccgccgggggagccgtgctggtcatggccgcttgcaataaacggcaaaaagattcggctgaaacgtgggaagatacggatatgagaaacagcaaaaaaatcgaccaaatggaaagtgtggatgcggacaaagtaccggaagaaaaagggctcacacagctggactccacataccgttccgaatggatcgcaaacggatttccgcaaacccataaagaaatgaaagaactggaaaaagaagggaaaaaatcataacggctctttacaccctttttacacaaaaggacgggtcacaaggtttttccttgctgcccggcctttttgcggttatacgctacgtctcaggagggattcgatcaaagtaggaaaattgcagggataaaaaagggatactgccacagtgttctaatctgcgttagcatcccttagctgtccaaaaccctttcatatcaagggtttatcttcaaaatgcgctacgtcccaggagggattcgaacccccgacctgcggcttagaaggccgatgctctatcctgctgagctactgggacattttaaaatggtttgttacgaacatatatcattttaatcagcaggcgggcaaatgtcaatcatgaatttgaaaaaaacacgattttttcctgcaacgggcgggtgcagcagcaggcagcggtttccgcaaccggattggcccggcttcgtacccgccttgctctgcagccggagttcccggcgtcataacgagaattcctggcgtaaatcctcaagttcgcggtgcttgtccgtataaaatgaaacacggatcgtatttccgtttttctccacaaccgcatacgtccgttccgtcctgccccttggcatcaaaaggctgccgggattcaggaagagagtattttcaatcagctcggcaccgagaatatgggagtgcccgaaaaaaacaaaatccgcccccacttcttttgctttataagacaaattcaacagggtcatttttacattataatggtggccgtgggtgacaaatattttgctgtccccaatttctttcgtgatatcaagcggaaatttccgctcataatcgcaattgccgcgcacggttaaaaagtcccggatggcctcctcgtccgctcgcaactccgaatcgccgcaatggatcatcgcgtccatttccccgccgtaccgccgtttaagctcgatcagctcttccgtaagtccgtggctgtcacttgcaatcagcagtttcattttttgccttcctcccctaaaatcgaatacagtgcatccgaaagttttgccagtgcatgggcacggtggctgattttatttttttcttcggcagaaagctgggcaagcgttttgccggacggaagcataaaaatgggatcgtacccgaatccgttctctccgatcctttcccgcgtgatccttccctgaagcgtcccggacaccgtaaatgtttcttttccagggcgggcaaccgcaagtgcacaataaaaagaagctgtacgtttttcatccggtaccccttcaagctcggaaagcaccttatcgatgtttgcctcatcatttttctctttccctgcatagcgtgcagaataaacccccggcctgccgccaagcgcatcgatcataagccccgaatcatcggcaattgccatcatgccgtatgcattggccgccgcttccgcttttaaaatcgcattttcttcaaacgttttccccgtttcctctacgtccggtgcgccttccatatccaaaaacgttttcacctcgagctcgaaccgggaaaataaagctgcaaattcttttgctttacctttgttttttgttgcaatcaaaacagccgccaattttctcccccttttaaaggaaatgtattatgtatgcacgatacaaataagaggtagtctggctaccccttttgtcccatattctatagtataacaaaaaaaccacgctaaaaactacccgtgttgactttttccggccttgtcaccggttctgaaaccgattttccgtcttctgtaacaagctttgtactgccgtccacttcgactgcaacgcttttaatccctttttgctcggtcagcgtcaggacgagcggatcgagcacttcgtttgagatcatctttttatcgaggctccctaaaatttctttattaaaatcaaccgtcactttcccgtttgccacttccggctgtttcttcagtttgacatcgtccatgaatccggacacaagatgggaacccggggaaggacctttaaccagttcttcaaccgctgctgcgacatcgtccttgttactgtccgcaacgcgcttcgttaccggcacataatagctttgctcccctgtttccgccaaataataaacggtgaccggatgggtatttgtaatatcggcaacatactttgtatccgtattgatgcctgcctcccttgtcaaaccatccgggcttacgggtgtccccgcaaccggcatcgccttcagttttttgccattcattttaagcgagaccttttgaatggagtcgaactgggtcagcgtccatgtgaccgattccaatattttttgttcatcgtgcgcttgatagtctttgaaatcccccgaaaagtcgaccgtcgccaaaccgtctttcacatctaccgacaactgcgtattcgcgggaaggaccgcgcggaagccgttcggcagcaaattggaaaccgggccgtcctgcacgaggtattccagtgcctgttttgcaatgcttttgctttcgggcaaggcgatcgtttgtggaacgacataaccgtatttatcaatcaaatacagctctgttagcacctgccctttctttgcttttgcggtttgtttcgctccgtcttttacagaaacactttgatgcggatcaattttttccggctgcttctcaggtagcaggctgcaacccgagatccagatgctgcatgccgcaaacgccagggcaagtttgccggctgcctttgctttttttaccatccctttcccctcccgaagactgtttgtactactatgtatactggcattccgaaaaattagaccggacatgcaaaaatttcggggcagaataaaaacggcacgcttttccataataaaaatacagctgaacaggagggattgatttggaccagacactgggcgttcatgaaacgcttgatatgcacgaaatattaatgtttaaaaacatctgcttaacaaaatccgcaaccatgtcggccattgcacaggatccggctttaaaagaactgctcgggcagaatgcaaagcaggcgaagcaggatatcgaacaactcatgtcgcttttggggagggaagaaaaatgaacggctttctccaaaacatcatcgggatgggggacatgtcagacagcatcattgcatctgacttgctcatttcaacaaagtccggtgtgaagatgctcgcgtttgcggtaaccgaggcggcaacagcggaagccagagccgctctttccgcacagcttctggcggccattgacatgcatgataagatcatggactttatgattgaaaagggttactatcacccttatcatatagaggaccagttgcatgtcgacatgcaggcagcccggaccgccttacaaatcccccttcccgattaaacggcgtacccactgctttactttacgtcagtttaaagcgcagccggccttctccctcttatctgctggctttcgctttacacatttgaagaggacaggcacgaaaaacccggcctgcttttaaaaaaagcagcgccgggctttttttacggcttgaggaccacttttatgcaattgtccgttcttgtatcaaacacttcgtatcctttttcagcctggtcaagcggcaatacatgcgtcacgatgtcgctgagtgtgactttttcctgcgccacaaggtcatacagaaacggcatataatgaatgaccggcgcctgtcccgtgcgaaggctgacattgcgctggaaaatatcgccgagcggaaatgcgttgtaacggccgccgtaaacacctgttacctggatggtgccgccttttctcaccgcctgtgacgcgatgacaagcgcactcatcgccccgccctggagtttcagcccggatgtcaaatattccatcggtgtcatttttccgtccatgccaactgcatcaatgacaacatccgcaccgcctttagtgagttctttcaaatattcgccggtattgtcgtgctgttcaaagttgacggtttccactttgttatacttcttggcatgctgcaaccggtaatccagataatcaacggcaatgacacgtttcgcccctttcagccatgcaaatttttgcgcaagcaggccgaccggtccacagccgagcacgacaaccgtgtcaccgtcttttacacccgcattgtccaccgaccagaacgcagtggaagcggcatctgaaagcaacacgagttcttcatctttgacttcgctgttttccggaattttaaacggtgtaaaattcgcatacgggacgcgtaaatattccgcctggccccccggatagccgcctgtcagatgggaatatccaaaatagccgcccatctcgccgttcgcattcgcattgtcacactggctttccagatggtgtgtgcaataccagcattccccgcaggcgacagtgaacggtataatcaccctatccccttttttgactttcgtgacatccggtccggtttcttcgacaatcccgagcggctcatgcccgatgatatagtcttccggaaaattcggtatcatgccgtggatgagatgcaaatcggagccgcaaatggccgatgacgtaattttcacaataatatcatcttttttctctattttcggttccggcacatcttttactctgacatctttgattccctggaaagtgactgctttcatgttttcctcctattcgtccgcatcaatctgcgccatcatgcccatgcgcgatgtattgccgggaaacaggttcagtttgccgatcatcaacgccatgtcagcggatttcatatccagtttgtactggtcatctacgttatacgggtggagccagcctttttgcatcatgaaatttgaaacctcttcatgaagggaaaggccctctgcaagctgtttctggaatgcggccctcaccgcaggcgttcttgattccgtaatggctgccgctgcattccggatcccggttttaatactcatcaaaaattcaagtgcaaccgctgaatccgccatttctggcatgccttccgcgttttcgatttccaagtaatcatgaatcattgcagcatccctcccggattcagcttgtataaagctttcatttcttgaatggctgcttctgcctgctgcacatctttttccatcaatgccttcaaatcctggtcgaataccaggccggacatcattttcgattttaataaacaaatggttttgaaattgagcatttcatggagctcccttgtttcgtggtaagccaaaccattgttttccatatatccacctccgtttttcaaaagctattgtgcctattcacagccgtttctatgcgggcttggatgaaggcaaaacaaaaaaaccacccaatcaggagagcgtctcccccaattgaatggtttccacaccagtaatatcctgttcaagccagtctgatgcaagtgcggcaaatattttgctcgagccggtagtgtaaaagcggtgcttctgccgcgtgtcttccatattaaaaaggtcatggaagtaaagaagcgtgctcacttctcgcgcggtttcctccccggaactgatgaccgaaacgcccgcgcccatcacgttttggataatcggcccgaggagcggataatgggtacatccgagaatgacggtgtcaatgccgcaattttggattggatacaaagtttcggcaacaatttttttggcaatcggactgttgtactggccgctttccacaagcgggacaaatttcgggcaggcaagcgccgtaatcttgacttttttattgatgctttttaacgcccgttcatacgcctggcttttaatcgtgccgatcgtgccgagcacgccgatccggaaattttttgtatgttttaaagcggcccgcgcgccgggataaatgacgccgagcaccggaatcttcagctcttctctgacttcgtccaaaatcactgccgtagccgtattgcaggcgatgaccagcatttttatttgtttgtccatcagaaatcggatcatctgccaagtgaattttttgacttcttccaccggccgcggtccatacgggcatcgtgctgtatcgcccacataataaatggtctcattcggaagctggcgcatcatttcctttgcgacggtcaggccgccaacccccgaatcaatcacgcctattggtgcattcaaacttctcgcctcattctgtcttcatttcctgatgcaattgcagtaagttgttttttaatttgaccagttcatccggtgaaaaatggctcagcacaccctgcaagtaagcttgccgttttcggatcacttcgtcgatcaatactcgtcccttttccagtaaatggatgcggacaacccgcctgtcatgcggatcttttacgcgcctgacgagttcatttttttccatccggtcaatcaggtctgtcgttgtactgaaagccaggtacattcggttcgacagttccccgatcgtcatatcgccttcctcaaaaagccattgaagcgccagaaactgtggcggcgtgattttataatcgcttaataattcacggcccttttgcttgacaatgccggatatgtaacgcaaatctttttcaatttgtgctacaacttccggatcatgtatgtatggttgctgttccatgtccaaagcggcccctctctcaaaaatacggtgatgactgttttactataagctattttgacccttttcacccgaaatttcaagacagatttttacatagtttcgttccattgctttccaagtaaagctgtggaaggaaaagcggcccggtatagggttgtgaaaacactgtccgggtaaaatttgcatattgaacaagcttccggtccgctattttttgaaaaagaaaacggcccggtgcggtttcaaaccatatggcgctgttgcgaacgacatttatgtgggtgtagacttgcataagcaacaccgtttcaaaccatatggcgctgttgcgaacgtgcaccgggtgcgggatgcagggggattttttgcccggcatttcccaaccggatttctatatgcgtgaaaaaacgtgcaagagaaattcggtcgggtaggccgtcactcagttacgagattcgtgataacggcacggccgcggtaaatttttaccactgctgcagcgcgcccttttgttgccgcctgctcgatttctttcccgctatgttgaggcacaaaaaatttatcaagatgataatcaatatacactttttgctcatcgtcttcccactcgtaagccttcccttttaaatatattccgccccgcggcttttcggcggatacacttttcacatggcaaatgcccttttcatcttttttaagcagggcatacacggtcagttccccgcctttatggcccgcaaaatactcgatggcactgcggtccagacggctggccggtaccgtttccgcttcaagattcacctgtatataatcgcccctgaaggcatccgtcgggtccaccggttccatttgcagtttgaccggttcccccaccgcaaccgtatataacggcaaaacaatcatcccgagtaaaatggcaatcggaacaaacgcagcaagccctcttttcaccagatcatgcatggccgtttcccccttctttccgctgcttttcaaaataaaagccaaaaccgataaaaattaggccgccaatgatgaaaacaatggatttcggcaaaaagtcgtaggaaaagtcaaggtaaaaacgcagcacaaaaatgcagagaatgaagatattggtaaggctgccggttttgataaaatacaggacaagcagaaagtacacaactgaaaatgctaaattgaagtggctgccaaaaaccgtaccttcccaaacagacgaaaaagtaagcaggatgcccatcaaaccgtgaagtaaatggccttccagccgcatcacttctctgtacgcttcctgaaccggcaatcgcagcatcacgaagccggcaacaaagagaagcagaaaggcagccaaatgtccgtatgcgggaaagaatgcactgagtttaaacagaaatacggacagcacggcaatcgaaagcgcgtttacgaaaaacagaagcaggcgggaagcaaccgttttttcatttatccagtaaagtaatcctgctaaaagtgcggtaatgagaacagcgaagtacccgatgccggtattttcagcatccaaatacaaaaggaaaagcactgtggcaaaaatggagagccatttgtctttcagcacataggccattggcagcgatccaatcccccaccataaaaatgcctggccgaatgagccgccaaggttaaaaatttgcccggtgagaaaaatgcccgccccgaaaaacaggacaccaagaaagtacaagccgcgtgctgttttcggatggctgttctccagtttgatagccgctccgttcacgcctgcaatcgcagcaaggatgatgagaaatttgaccgttttgccaagatagacccaattgctggcaataaagctgaaaatgcccgccccaagcaaaagggccccgaccatgacaagaatgcggacaaggctcaccccccgggaaacctcatactgtgcaagcatctcgtctttttgcgtatgcgtaatggtcccttcttcttcaaaaaaagcaagctcgcttttcatccatgcatagttttttctgccaatctttcttttcattttgactccccctcattttgaaaaaagcgcatacagaacaagcaagacatggatgataaataaaaatagaatgcacagtgacgctttgtatgacactcctttccttgagagtagccagataagccacatcacgacaggcaaaatggaaaaaccggcccacttatttataaatccgtccggccgtaaatatccgttaaaatggaacggaatgatcgccggtgcaaatgcaaacccgatcagggatacaagcgcggcaaccagtatcaaaataagcaaaaatgccggatccgtcactttgagaaaaaaccgcataaactcacatcctttcatgctattgtactgtattttggcgaatgttcatatcatttttccaggcgggaaaagccggaaacaaaatgccggcaaaatatcattcgcccgtatgttaaattgcgatgcttgcagctataaatttattaatctacataaaacgtgccaaaatcaatgacgttcaggacagacattgcttctggcaacgtataaagaagtagtaatgtttagttcaactatatatcctgaaaatatgtgccggctggctttcattcttctgcttgtggcgcatccattgcggtatgggcgtctatttgcaaattgggcacagcggcgtttgattttagcccaaatcgtccggcatctttggagaaatcttcacactgtctcattgaggcgggcttgtaaaaaagataacatccggaaacctgtaaaaacatcatttgtttctccatcctcgtgatttccttatacggtatccagcgtttaaacggcccgcctttttaacatgatccattttcgatcggaacttcattcaaacgtccattgaaaacgattccgctacgtgcacttgtggtcattttactaaaaccgccggcagatttccaggttcatctaaaaatatgcaatcaatgtaaaaaacggaatcagaaagggtaaacgctttgtccaaaaatcatcccgtttctatcccttctttaaaccacaaaatcgactgcaacattgcagccgattttgtttcaaagctttaattcccccatgcggagtaattcaacaacagcttgcgagcgccccttgactcccaatttctgcatggcgttggaaatatgatttcgaactgttttttcgctgataaacaattcgctcgcgatttcttttgttgtcttgtcttgtactaacagctcgaatacttctttttctctttttgtcagcagcggtttatgtgtgaaatcgttgtccttcaactatgataaccctccttgccttcgccagctctaaaccgcggggatgggtattttggttgtcacgatatcttatgttcttgcgcggccgggagtgacttgacgaggcaaggaacagcacaaatccgaaaaaaagggcggatgccggaaccctttctgtatgaaaggcaaacgaaacattatccggcattgtaaactggcagatatagattctatttatgtcctggccggagatggcaaaacaggcaaacaagtgttgtaaaagcaataaaatataccaagtattgccgctcttttctccgctaaaaaacagtcctcaacgtaaacacttaagcttattttttatggcgggttactttcattcagttgacggatgtgacggcggcttgcgggtcggcgaacctcgctctttcttccgcagtccacggtattccttttccggttgtgaccgagatctgcaccattgtcccgcgcccggtaaaacagatttcattcgcttcatttttcgccatgtagtgcaagtcgacggacgagttgccgatttttgagacttttacataaatgcggagtttgtcattgaaaaaaacctgttgtaaaaaatcacactgcaaatccgccacgaccgggatggagccggtgcctttttttgcccagtcgcccataaacccgagttgctggagaaattcaatccgcgcttgttcaaaataaataaacggaaccgtattgttcatgtgaccaaacatatcggtttcagaaaaacggaccgtgaccgggagataataggaaaatccttcttcccaggcgttccagtcatcaatataagagatgtgctttttcaatgggatacctccttttaatgagtgaacaaccattcattttttatttgaaaagaagtgccacatctactgtttccgctttgatgtggcacttttggcattagtcaaccgtatggtcactgccaaagaattttttaaacatatagatggttgtttcacggtttaatgctgcgatggatgttgtcagcgggatacctttcgggcaggcttgtacacagttttgcgagttgccgcaattggcaagaccgccgtcacccatgatcgcttcaagtcgttcatcgcggttcatatggccggtcgggtgcgcattaaataaccgtacttgcgaaagcggcgctggcccgataaagtttgaacggctgttgacattcgggcaggcttccaaacatacgccgcaagtcatgcattttgccagttcataagcccactgcctttttttctccggcatgcgcggcccttcccctaagtcgtaagtgccgtcaatcggaatccaagctttcacttttttcagcgagtcaaacatgcggccgcggtcaatttgcaaatctctgacaaccgggaatgtccgcattggggcaaggcggatcggctgctgcagtttgtccacaagcgctgaacaagcctggcgtggtttgccgttaatcaccatggaacaggcaccgcaaacttcttccaaacagttcatttcccaaacaacaggtgttgttttttcccctttggcattgaccggattccggcggatttccatcagggccgaaatgacattcatattcggccggtacggaacttcaaacgtttcgtcatatggttctgattccggattatcctggcgttgtatgataaatgtaacggttttttgttcacccatccttattctcctctttccttatgaaatcacccgggcaaaagccggaaaaaatccgtttttgcccgatccgaatcagtgcttcttcgtgtagtcgcgtacgcgcggtttgatcagcgatacatctacatcttcatagctgaagaccggttcattgttcacagggtcataatttgccatcgtcgttttcagccattcttcgtcgttgcggtccggaaaatcaggtttatagtgggcaccgcggctttcattgcggttcagagcgccgatcgtgatgacgcgcgccagctgcagcatgttatacagctgccgtgtaaacgaagccgcctggttgctccatttcgatgtatctacaacattaatatttttccatctttccattaattcctgaatcttttcgtccgttttcttcagacggtcattgtaacggacaaccgtcacattgtctgtcatccattcgcccagttctttatgcagcacataggcattttcggttccgtcaagcgacaaaatatcgttccattttttctcctgttcttggacagcacgttcaaagacggttgacggcagtgcatccgtgctcttttcaagcccgtcgatgtagttgacagcttcagggccggctaccatcccgccgtaaatggcagaaagcagggagtttgcccctaagcggttcgcgccgtgcatcgagtagtcgcattcgcctgctgcgaacagccccggaatgctcgtatgctgtttatagtccacccataatccgcccatggaatagtggacggccgggaacactttcatcggcactttatgcgggtcatcgccgacgaatttttcatagatttcaataatcccgcccagttttacgtccagttcatgcgggtctttgtgcgacaaatcgagataaaccatgttctcgccgttaatgccgagtttcaagtccacgcagacatggaaaatttcacgggttgcaatgtcgcgcggcacgaggttcccgtatgccggatatttttcttccaggaaataccatggtttgccgtctttgtacgtccagatccgtccgccttccccgcgtgcggattcactcatcagccgcagcttgtcatcgcctgggatagcagtcgggtgaatttgaataaattcgccgttcgcatacgttgcgccttgctggtatacaatggaagccgccgaaccggtattgatcatcgagttggttgatttcccgaaaataatgccaaggccgcccgatgccataatgacggcatccgcaggaaaagctttgatttccattgttgtcaggttttgcgaaacgatgccgcggcaaatgccttcatcgtctttgataatgccaagaaattcccagccttcgtatttcgtgacaagcccgttcacttcatggcgccttacctgttcatccaatgcgtataaaagctgctgaccggttgttgcgcctgcaaatgctgtccggtggtgctgggtgccgccgaaacgcctgaagtccaaaagcccttccggcgtgcggttgaacatgacgcccatccggtcaaacaggtggataatccccggcgccgcttcgcacatcgcttttaccggcggctggttggcaaggaagtcgcccccgtataccgtatcgtcaaagtggatccatggcgaatccccttccccttttgtattgacagcgccgttaatgccgccctgtgcgcaaacagagtgcgacctttttaccggcactagcgaaaacagatcaacctgccggcctgcttctgcaatttttacagtcgccatcaaaccggcaagccctccgccgacaacaatgattttgccattagccaacttgattcactccctcttcatacttgatgcctcttacaaaccagtaaactgctatttttcgaatcttttcattatgcaaatgctaataaagccctgacgccgacaacggaaagcagcacaaagaccacaaccatcacatatgtggaaatttgctgtgaccggcgtgactgtgtaatgccccagctgaccaggaacgaccagagaccgttggcaaagtggaaaacggcagccactgtcccaattatgtaccaggcgagcatccaacgatttgctaatagatttgccatcagatcaaagttcaattccttgccaaacgccatttgaatgcgtgtttcatagatgtgaaatacgagaaagatcaggaccaacacaccgctgattctttgcaaaaggtacatccagttccggaagtagcccatcgtgccgacattgctcgatgccgtaaacgaaatatataagccgtaaattgcatggaacaaaagcggcaaataaatgaacacgacttccacaaaaagcagaaacggcaggttttccataaaaccggctgctttattgaaggcagcagcaccgtttaccgcatagtggttcacggtcaagtggatgactaaaaataagccgatgggtataacacccagcaaagaatgcagtttgcggttataaaactctcgatttccagccacattgtatccccctttgtagtgtgaatttatgcaaagaagacaaattttgcattgcttcctcccgcataaatattttataacaattatgtgacagttttattgtactcccgacaaatgggcgcgtcaaggaaacgcattcatgaatttgcgctgaaaataccgtttatttgtcatatttgtcagtctttctcccattttttaaaattttttcagtatagctcttttgccatatgcttttgcataaaaaaggaatttttatccaaggcttgtcttttttcatcggattttaccgcaaccggcataatttccccatgtgacgcggaagccggcgaaaaaaagttcccattatttttgtgtacactcaaaaaatgcttttaagtccggttttattttgtatataatatagcatatagaaagaggggaattgcgtgaaatcttctggcggaaatgaacaaaccgttgcggaacagctaatggtgcccgcattcggatatgagctgttgcgtaatatattaattccggatatactcggcaaggaaacaccggatattctatactgggccggaaaacatttggcaagaaaattccagctgcttacctatgaagaaatggtttcttttttcaaagaagccggctggggaacgttatcgatcaaaaaagaagagaaatatcatatcgaatttgagttatccgggccgatgattgaacggcagctggatatgggcgcaggtcaagagccgacattcaagcttgaagccggttttttagccgagcagtaccagatgcagaaaaaactgatcacggaagctgttgaggaagttgcgaaaaaagcaaaaaaagtccggatcaccgtgcagtgggatgcgaaagacccggccggagaatcaatatgaaaaagcagggggctcccctgctttttcatattttcatatattttgttccactgcatccagttcaaatgcttcgtgcaggcaccgggcggcccggaccatttcttttgcatcgacaacggtggacactttgatttcggacgtgctgatcattttaatggcaatgccgtgatctgccagcacctggaacatttttgccgcaacgcccgggttggaaaccatgcccgatccgatgatggacacttttgcgaggccggtttccgtttcaaaatggtcaatactgagggcttctttcccggcttccaaaagatcggccgtttcttttaaatctttatcttttatcgaaaaagataaatacgttttatggtccgctgtctggttctggataatgatatcgacatcaatatggtgttccgccagtgtcgtaaaaatatccggcaaattgcggaagccgttttccagtccgaaaatggtcacccttgtaatgccatcttcaaatgcaacgccgcggacaattaaatttttttccaccgaaacttcctcctctattaacgtgccttcctccctttcaaggctcgaacaaacgatcagcggcacagccgcatttttggcaaactccactgcccttgcatgcaaaacgcccgccccgagactcgccagttcaagcatctcatcataggatacagccttaagcttccgggcattcggaatatagcgtgggtcggacgtaaacacgccggtgacatccgtatagatcaggcagcggtccgcatgaagcgctgctgcaagcgccactgccgttgtatccgagccgcccctgccgagtgtcgcaatttcgcctgccggggtgatgccctgaaacccggcgacgattacaatttgcccggctgccagacgggatttgattttttcagtccggatttccgtgatccgggcgtttccgtgtacgggttccgttataatgccggcctgccatccggtataagaaacggcatcgtagccgcgagcgatcagtgccatggcgacaagcgaaatcgtcacctgttcgccggttgaaagcagcatatccatttcgcgttttgcaggatacgcagaaagttcatttgcaagcccgacaagctggtccgttgttttgcccatcgcggaaacaacgacgacaacatcatggcccttttccttttcttcaataatccggttgaccgtattccggatcctttccacatttccaaccgaagttcccccgaatttctgaacaatgattcccaataactccgccaccttctgcagtttataagtaagatgaggctgtcagagtgaaaggcaaagcaacttggcgcccatttaaaaaaagcaatgagaacggatatctcatcgcttttgcatacgcgggtacgcagtcattcctgtgagatagcgctccaagacatttcatcctgacagttccggactttttcagtacagaaccagcaaaaacggcattgaggccattttcacttcggcaaaacttcctttcagaaacgatcccggaagcccaatcttctcccgcttcttactcttaagttttgcgcctctatcatgtaacggctttgccggacgccgggatgatcgcacccgaaagtctgaaacaaagcctgccatatgaaattatcatgattataccatatacggaaaaaccctgccaggttattcttgtaattttttgattaatgtttcggataccggacgcgggatgcccgcttccacaaattcttccagctttgcttgtttcattttcttcaaggagccaaagtggcggagcagttgttttttccgtttcggcccgatgcccggaatatcgtcaagcgccgattgaaaagcggattttccacgcaattccctgtggaaggtaatcgcaaaccggtgcacttcatcctggatgcgctgaagcaggtaaaattcctggctgttccgcccgagcggcacaacttccaacgggttgccgaacaaaagctgcgatgtattgtgcttctcatcctttgccaggccgccgatcgggatctcaagcccgagctcattttcaagcacatcccttgccgcgtcaatttgcccttttccgccgtcaatgatgatgagatccggaagcggtaagttttcccttagggcacggatgtaacggcggcggatcacttcgcgcatcgattcataatcatccggtccttccactgttttgattttatatttgcggtattctttttttgccggcttaccgtccacaaacacgaccatcgccgaaaccgggtttgtcccctggatattcgaattatcgaacgcttcaatccgatgcggtgtgtagatgccaagcttttcgccaagattttcaacggctttgatcgtccgttcctcgtcccgttcaatcaacgcgaatttttccttcaatgcaatctttgcgtttttctcggccattaacacgagttcccgtttctggccttttttcggctggagtactttgatttcgagcagttgttccgccagttcccggtctgctttttccgtaatcagcacttctttcggcttaatatgctccggtttggcataaaactgccccaaatagctcaaaaattcctcctccggctcatcgtaagacggaaaaagcgagacatcccgttcgatcagctttccttggcgcatgaaaaagacctggacgcacatccagcctttatccactgcgtagccgaaaatgtcgcggtccgtaaaatctgtcattgtaattttctgtttttccatcgtcatttcaatattggcgatctggtcgcggtattcttttgcccgctcaaattcaagcttttctgcagcctcatgcattttttcttccagttcttttttgatttccgtgtaacccccgttcaaaaagcgggtaatttgatcggtgatctctttgtatgtttcttctttcacctcattgacacacggcgcaagacactggcctaaatggtaataaaggcagacgcggtccggcatattggtgcatttccgcaaaggatacaaccggtccagcagcttttttgtttcattagccgcctgcacgttcggatacgggccgaaatatttgcctttatcttttttcactttccgggtggtgatcagacgcgggtggcgttcatgggtcagcttaatatacgggtatgttttatcatctttcagcatgatgttgtatttcgggtcatgctttttgattaaattaatttcaagaataagggcttcaatattggaagaagtgacaatatactcaaagtcttcgatctcgctgacaagccgctgcgtttttgcgtcatgcgaaccggaaaagtaagagcggacacggttttttaaaattttggccttcccgacataaatgatggtcccctgtctgtctttcattaaatagcagccgggttgggcgggcaggagggcaagtttattgcggatcgtctcgttcaatttctcttcacctcaaaatcctgcgttctgtaaaaaacccggaccacagccggcccggattttaaaatgcatttgcgcacggcttgaagccgagcgtttattgtattataaatgtttgttcactaattcttgcaaagcttctttcggctggtaaccgatcactttgtcgaccggtttgccatctttcatgagaacaagggtcggaatgctcatgacgccgaatttgctggtcgtttcctgattctcatccacgtctactttgacgattttcaccttgtcgcccatttcagcatcgatttcttcaagtaccggtgcaatcattttgcacggaccacaccatgttgcccaaaaatccgttaataccaaaccttggctgacttcctgctcgaaagtcgcgtcggtagcatgtgtaattgccatattgaaagaaccctcctaaatcaaactattactgcttgggataagtatatcatcctttatcatatgttgcgaacaatttgtccggtccggaaaaagcagtaatgattttattattttatacccttttttcacgaatatccaacagaaaacaggcccggaacgaattttttcgtccgggcccgggattacgccgatgtgactttcagttttttgatttcctctgtgagaagcgggaccacttcgaacaggtcgccgacaatgccgtaatccgccacgttgaagatgttcgcttccgggtctttgttaatggccacaatcactttcgagttggacatgccggccaaatgctggatggcaccggaaataccgcatgcgatatacaaatccggtgtaaccactttgcccgtctgcccgatttgcagagaataatcgcaatagccagcgtcacatgcgccgcgcgaagccccaaccgcgccgccgagcacatcggcaagttctttcagcggtttgaagccatccgcgcttttcacgccgcggccgcctgaaacgatgactttcgcttccgaaaggtcaaccccttcacttactttccgaaccacttctttgatgatcgcgcgtaaatctttaattcccgcgtcaacggtttcgatatcccctgtgcgtgattcatctttttcaagtgggctgatgttgttcggccggatggttgcaaagatgatcccgtctgttatgatctttttctcaaacgctttgccggagtatatcgggcgggtaaagacgacatgttccccggctgattccactgcggttgcgtccgaaatcagaccggcatccaatttagccgctactttcggggccaggtctttgccaagcgccgtatggccgattaagatgccatccggcttttcagattcgatcaccgcaagcaatgcttgggaaaaaccgtctgaagaatagcttttcagcttctcgtcttccaccacggcaacacggtcagcgccgtattgaatcatgtctttccccaaatctttcacagcgtccccgatcaaaacgccgaccacttccccgccttctgctaccgtttttccggcggcaatggtttcatatgatacattgcggagcgatccgtcacggacttcccccactactaatacttttcgactcatgctgatcccctccatttccggtttcttcgcttaaatcacttttgcttcattatgcaataattggacaagttcttttacctggtcggtgatttcgccttcaagcacttttcctgcttcttttttcggcggcaggtaaacctcgatcgttttggtttttggctccacgtcttcttcttcaaggtcaaggtcatccagttccagctcttcaagcggttttttcttcgctttcatgatccccgggagcgaaggataccgcggctcatttaagccttgctgcgctgtaacgagcagcggaagggtcgtttcaatgatttcggaatctccttcgacatctcttgtgaccgtcgctttgtcgccgtcaatttccagattggtaatcgtcgttacatacgggatgccgagcaactccgccacccgcgggccgacctgtccggaagcgttgtcaatggcgacattcccgccgataatgagatccggttcctgctcttttaaataagcggcgagcacttttgccgttgtgacctggtcgcttgcttccacatcgtcttcaatattaatgaggactgctttatccgcacccatcgcaagtgccgtccgcaattgcttttcggcttcttcattgccgactgtgacaactgtgacttcgccgccctgggcatcgcgtacctggatggcctcttcaacggcgtattcatcgtacgggttgatgatatattctgccccgtcatcctggatgcggccgtttgcaatcgcaatcttttcttctgtgtcaaaagtccgttttaataatacgaagatattcatgccgttccctccctaaatcgttaaaaaataaaatcttttaagcgcatacaaatcaaaaaatgttaggcccctgtaaaacgcggttcccttttttcaataaaagctttgatgccttcctctgcatcttttgagccgaacagctcaagaaaacgtgcggattcctgctccaagcctttttcgtaatcgtttgtttttgaataattgacgagttcaatagaggctttcagggccagcgggcttttctttgcaattttttcagccagcgcccttgctttcgggagcagttcctcttctttataagcatggtttgcaagcccgtgctgcacggcctccgttccggtcagcggttcgcttgtccacagcatttcaaatgctttgccgcgtccgacataccttggcagccgctgcgttccggcaaaacccggcacgagtccgaggctcagttccgggaggccgagttttgcattttctgtgacaaggcggatatggcatgccatcgcaagttcgagcccaccgccaagtgccgcgccatggatcgcggcgatgaccggtttcgggaacgcttccactttttcgaacaattcctgaccggaaaccgccagcgcatcggagccgccggatttccttaattggacaaattctttaatatccgctcctgccgagaaaaatcttcctttcccgtaaaggagcacgacccgggtttcaggatcgttttcaagttggccaaacgcttgcgcaagttcttttaaaagagcctgcgcaagcgcattggcaggtggcctgttcatttcaatgcaggcgaccgcattttcccgtttgatcgtaataaattccatcccgtctcaaacccccttgtgaaagctgcggcattaaaccgccgtttttttgccgcagccgttaatgatcaattgatggacgggagcagccagtgaaacgaggtcgtatttttctttattcatcacccatgtcgttaccgtttcatcgactgtcccgaaaatcatctgccggacgagccggacgtcaagcccggaatcgaattcgcctttttccatgccttcgcggatgatttggtcaacgagcgtcaaatattctttcagtacgctgttgattttaagccgcagatctaaattggtctgccgcagttccagctgggtcacgaccgccaaatggtgatcggcggcaaggactttgaagtggttttcgatcatcttgagcaacttttcggaaggggaaaggtcccctgcaatatattcggaaaccttttcgataaacagctgcatcttttcttcaaacaaagaaatcaggatatcttctttgtttttaaaatacaaataaatcgtgccgtccgctacgcccgcctgttttgcaatttttgaaacctgtgcctgatgatagccgtgttgtgcgataaccaccactgctgcatcaataatttgtttgtactttggcctgtttttcctcacgggctatcacctttcaatctcatgatctgtcaatttggccgaccggtttaatggcggccagaaaatgaatgaccattcattcatattttcatattatacaagaatgcagcatttgtcaagtcctgtttataaaaaaatttccttacccgatcttctctcctccattttccatcttttctttttcttctgcaaccaatgagcgccgcaaaattttcccaacggccgttttcggcagttcatcccggaattcgtaaatgcgcgggactttatatgccgccagatattggcgtgcaaaccggtccagttcttcttccgttactgtcatattgtctttcagcacaatataggctttgacggtttccccgcggtacgggtgtggcacgccggcaaccacggcttcctgaacggcagggtgctcatacagcacttcttcgacttcacgcggataaatattatagccgcctgcaataatgatgtcttttttccggtcgacaatataaaaataaccttcttcatccatataagccaaatcccccgtaaatagccacccgtcttttagcacttccttcgtttcttccgggcggttccagtaacctttcatcacttgcggcccttttaccgccagctcgccgacttcaccgggcggtaacggcctgccgtcttcgagcgagcggatttcgcagtccgtatctggccatggcacgccgatactgcccttgacgcgttttccccatacaaaattggcatgggtgacaggagaagattcactgaggccatacccttccacaagcttgccgccggtcaccccttcaaatttctgctgaacttctaccggcagcggggcagaaccgctgatgcatgcttcaatcgatgacaaatcatattccttaattttcgggtggtttaaaagcccgatataaatggttggcgcacccggaaacaaagttggccgctgtttttcaattgtcttcagcagtgactccgcatcaaagcgcggaattaaaatcattttaaagccctgcatcacagaaagaatcagcacggtcgtcatgccgtacacatggaaaaacggaagcatgccgagcaccacttcttccccttttttggccctgtacatccaggcatcacacattgtcgcgtttgcaatcaaattgagatgtgtcagcatgacgccttttggcacgccggttgtgccaccggtgtactgaagaatcgcaaggtcctcttcgatatcgaacggcgtgtcaagcggttccggaatttcttccttcatgatgttctttagcaagtgatggtgcccgccgtgctcgacccggacagtaacgcccgtttgctttttctgcagaaacgggtagatgacgtttttgggaaaaggcaaatactcgctgatggcggttacaataatatgttcgagatcggttttctcaaatacttttgccactgtcgggtacaggaaatcaactgtcaggatggccttcgcgccggagtctttcagctgatattccagttccctttccgtatatagcggattcgtcatgacggctatcccgcccgtgtaaaggatgccgtaaaaaccgatgacggcctgcggggaattcgggagcagcacggcaaccctatcgcctttttccactccgagtttttttaaatacccggcaaatttgagcgccgcttcatacacttcacggtatgtcatttctttccccataaaatggagcgcttttttgtcaggatactgttcagctgcttcggttaaaaatgcacaaaccggttttcgcggatacgtaagggaaacgggtatttccggcggatactgggacagccatggcctgtctgtcatttgcatcaactccattttgcatcttttattgacttattttattataacgaaaattgaaagcgttgacaattatttgcagccgaaacaggagaaggatgcgctccttctccttgtcacgggctaatctgcaacaatcaaataaatgacgccaagcaatgcaaaaacggcacagcaaacaaacaaaatttttgccagcttttcgagaaacaaaaggccctcccccttgcccttgaaaattacttgaattctacaatcgtaacgccgctgccaccttcgcctggttccccgagacggattcgttttacggcgcggtgatgttttaaaaattcctgcaccccgttccggagcgcacctgttcctttcccgtggatgatcgaaacgcgcggatacccggctaaaagcgcatcgtcaatatatttttcaacttttaagagcgcatcttcataacgctccccgcgcaaatcgagttccaggctgacatgggaatcgcgccccctgaccgttgccaggtgcttctccggctgtttttgttgcggcggccggatatattccatgtcggattcttttactttcattttcaaaatacccatttgcacgagccactcgccgcctgccgtttgttcaagcagcgtgcctttctggttgaagctgagcactttgacttcgtcgcccggctggtagatatgctgtttttttgcttttgccgccggtttgcggtccagtttcggcgccagttcctccagctgttttcttgcatcaatcagttcatgttctttcacattggctttggattcaagctgcattttccgcaagtcgcggatgatctcttccgctttttcctttgcctcttccaccacttttgccgcttttttctccgcttttccgtacagctcatcgcggcgggcataaaacgccgccatttgtttttgcaaatcacggtgcagttcctcggcatccttcaacagttcctgcgcttcctgccgttctttttccgcctcgcgcctagccgattcgagcgcggcaatcatattttcgacctcgtttgtgtccgcgccgattagtgattgggcgtgttcaataatggacggggagagcccgaggcgccttgagatttcaaacgcattactccggccgggaacgccgattaaaagccggtatgttgggcttaatgtttccacatcaaactcgacgcttgcattgacgaccccttcacggttataagcgtatgccttcagttccgggtagtgggtggtggcgacaacgcgggcctcccttttgtacacttcgtccaaaattgaaatcgcaagggcagccccttcctgcgggtcggtaccggcgccgagctcatcaaacaggacgagcgactgatcgtcgacccgtttcaggatttcaacgatatttgtcatatgggaggagaaggtgctaaggctttgctcaatcgactgttcatcaccgatatcggcaaatacttctttaaaaacagccatttccgaaccgtccaaagcgggaatttgcagcccggcctgcgccatgagcgtgcacagcccgattgttttcagcgtaatcgtttttccgcctgtattcggcccggttatcacaatggtcgtatattcctgcccgatcgtaatatcatttggcaccactttatcggctggaagcaacggatgacgcgctttgaacatacggatggcgccatgattgttgatcaccggtttcgaacctttaatggaccggccgtataaagctttggcaaacataaagtcaaaatcagcgagaatttcaacgatggtttcaagctccccgccggctgctgccactgcggcggacaattcgcttaaaatcctttcaacctcctgctgctcttttaaatgccattcacgcagctggttattcaagtccaccaccgattgcggctcaatgaacaaagtctgtccggaagaagactggtcatggacgattcccccgtaatttgcccggtattcctgttttaccgggatacaatagcggtcattccggatcgtaataatcgcatccgacagcattttcgccgcatttttgccgcggatatagccttccagtttttcacgaatgcgccgttccgtaccgcgcagcccgtgccggatttggcgcagcgtttcgcttgccgagtccagaatttccccgttttcatccaccgcattccggatttcatgttcgagcggcgtaaggaccgcaatcctgtccaccatgcttgttaagatcggcagttctgtttcttcttccgtgattccttcaataaaccgtttcatcgttcggctgacatggatggtgctggcaatctgcaccagttcctgcgggttcagcctgccgccgatcgccgctcttttcagatgacggcggatgtcataaatgccgaaaagcggcacatgcccttttaaacgcagcacttgcgccgcttcatccgtctcctcctgcatccggaccacttcttcataggaagaggagggaaaaagggcttcaattttttcggccccaagcggagaagaagcgtgctcaagcagcagatttttaattttatcaaactcgagtgttttgatgattttatgttgcatctattcgtcctccatgcattccggattccagcgttccggaaaactgccctctattcattgcagaaagggaatggatcagtgctgatgtttctgttttaaaaactcaaggagttgttctttcgtatacgtattgaccacatttttcctttcaatccagccttttctcgcggtgccgacaccgaaagcgatattgcccagttccgcagttgcgtgtgcatcggtgttaatcgcgattttcacaccggctgcctgcgcttctcttgcacgggccgctgaaaggtccaatctggcggggtcgccgcttaattcaaggatcgtgccggtttcctttgcccattggaaaagcaaatcaaaatcgacatcgtacccctgccttttttcgattaatcttccggtcggatgggcaatcatgtccacatgcgggttgaataaagcgttgcgcagccgtttcatgatctgcgcgcggctattcccgaaccccgaatggatggaagcaatgacgaaatcaaggcctgacagcacatcatcatcaaaatccaaagtcccgtccggcaaaatgtccatctcaataccggacaaaatcaagatatccggatatttttcatttaaccggcggatttcattcatttgcctgatcaaacgttcacgtgaaagcccgccggcgacttttaaatatttagagtggtccgtgattgcgatatattcgtaccctcttcttctgcatgcattgaccatgtcttcaagcgaatctttcccgtccgaccagacggtgtgcatgtgcaggtcgccctttacatcatcgatctggacaaaaggcgtccccttataggtttccacctcgctgccgtcagcgcggatttccggagggatgtaaggcaggccgtaatgatgataaaacgaagcttcactcggaaaacggagcaattcgcctgtcttcagaattttgacgccggattgcgtcagccgctcgccatgaagaccggcaatctgctgcattttttccagatgcggttccggccctgttgaaagaaaaagcgtcatcgcatacaggtcaggcaacgcgatccggaaattgatccgtaagccaggttccccttttaatttagccgttatttttatactccggatagaaacagcttccacgacttcgttcatttgaagaatgtcctccgcaaccgattttggatcgaatgtagagatgacataatcgagttcttctattctttcttcaaaccgccggatactgccggcacgcgaataggtttctattttcctgtttccggacagcgtttcttcgatcagcaaaagtaccggcagcagccggccgatggtataagccggtttccccgaaagctggtcaagcgcgtgcaaaagattggactgcgtcgtttttccaaacccttttaacgtttcaacttttccttcttcacaagctttccttaaagaatccgcatctgtaatgccaagttccctgtaaagccttgatattttcctggcaccaagaccctgtatctgcatgagcggaaccagcccttttggaacttcgtcttttagttgttcaagcagggtggaccgcccagtttccacgaactcttcgatgacggaagcggttgtttttccaatatgaggaatatccgtaaaacggctgatttctgacaagtcacgcccatccgcttccaaggcagatgcagccctgcggtaagccgcgattttaaaatggttttcgcctttcaattccaagtaaaccgcaatttgttccagcagccggatgacactgcgtttatttgtccgcattcgcctgccccctttttaacttattaagtgaaggatcgggtttttaccgttttcccgctacgatgattgggaaagcgcccttccaatggccgcacattttttccagcagcatgggaagtatttgaatccgtgcccggcattcaagccccgtccggaaaaaaccagcatgtacacgggcgatcccctccataaagaaacactcccccgtcgcgagaagtgctgttttgaaaaacccattttcaacccgtttgcaaatggtaaacgtgccgcccgggtttctatttcacccaccatgacgccacaagagctgaaatataaggtgtatttttaatcatgccttctgcgactgcggatgccttgagcgcggattggatctcatccaccggcagcaaggatccaatatataaaacgataaaaatgatcaagtacagctcggcaaaccctaggatgccgcccgcccatccattgacttgtttgaggaccgggagctgggccaaaaaggtaagggatgacccgacaatatttagaagtatcctgacggcaaagaaaagaatggcaaacgcaatgatccggtaaaatgccgtttccatattgccctcgtgcatcagaagggcaaatgagctgtcgctgttaaaagaaggatacggaatcattagcttcaatttttccgccaggtcatcatacaatatgtacgcaactgcggaggcaattacaaaccctgtgaggtggacagcctgcaatataaatcctttccgcttcccgttcaggaatccaagcacaagcaaaatgatgatgatcaaattaaccattttcatcttcatcctttttcaacaattgtaaatagtgctgttcaagcagctcatactgctctttcagttttatataatcatggacagcatttacggctgtcagcacagccactttgccagtatctaatgaaggattcttcgcgctgatttcccgcattctttcatcaaccatcgaggcaaccaggcgaatatggcttgccggatccgttccgattatggtatattgctgtccgtatatgccaacagtaattcgggttttttccaatgttgcctgcctccccatttgtaagaatcctattctctatcatagcatgacggaaaagcctttgtctaacaatgtcgaacaaattcaaggagatcctgaaactgccggaggaatcaaaatgtcaaatactgtcattctcgtttcagcttcaaccatgcaaaaaatgaaacaatcttatcaaaacagcctgtcaggaaaagttccgtccggcgccgtttttgccgcaaaaataccaggctgctccattaccggctataagtccggaaaagttttatttcaagggccggccgcagaaacggaagcgtcaaaatggggacagccgctggaaaagaagccggatgccgcccggagcgcaaaatcttccggcaacccgctgcctcctgatatcggagagctttccgtcattggatcggatgaagtcggaacaggcgactttttcgggccgatgacggtcgtcagctgttacgttgaaaagaaacagctcccgcttttaaaagaactgggcgtaaaagattcaaaaggattaacagacagtcagattgccggattagcgaaagaactgctcacctttgttccgtacagcctgctcattttgccgaacgaaaaatacaaccggctccagcaatcgggcatgtcgcaaggaaaaatcaaagcattgctccataaccgggctttgtacaataccgcccaaaaaattgcgccggcaaaaccggatgcaattttaattgatcagttcgcagaagcgtccacttattatcggtatttgcagaacgaaaaaatcgtcatgcgtgacggcgtctattttagcacaaaaggggaaagcgtccatcttgcggttgcggccgcttcaattctcgcacgctatgcttttgtccgggagtttgaaaaattgagcaaagaagccggatttgttttgccaaagggcgccggtgcacaggtggaccgggctgccgcacggctcatcaaggaaaaaggcatggccgcgctgccacattttgtcaaactgcattttgccaatacggaaaaagcaaagcggatcgcgggcgtgaaataaaggatggtgggaaagacatggggtgacgataggcgataaattttgaaggaaaggctaacgaggagggacgttaagcgaaggaaacggaaacggatgaattttcccgtgcatcttaacgtagacgggggctatgggaaggagggacttcgtttttgcttgcttccttaacgtagacgcgctctatgtaaagaaacgccttcgtttttccgcgcttccttaacttagaggcgccctatgtgaagaaaggccgcctcttttccgcgctttcttcatgtagacgcactctatataaaggaagatcgtcaatttccaccgcttccttcacatagacagcgctttgatttttgcactaaaaaagaagaggcctttaagcctcttcttttttcttgggattagccccgtagtactgcgcctgctttttcttttacggcggcaagtactttctcatgctgggcgacgacttcttcatctgttaatgtgcgttccggatcgaaataagtaagcgagaaggcaattgattttttgtcgggttccatatgctcgccttcgtataaatcaaaaatcgaaacggatttcaaaagggttccgccggcctcctgaatgattgcctgcagccgggctgcttccacatcgcggtcgacaacaagcgcaatatcgcgggtgatagccgggaagcgcgggatcggccggtattgaaccggttcggccgggtaatggtataccggctccagtttcagttcgaacacgtatgtttctttgatatcgagttctttttgtacgtttggatgcacctggccgacaaaaccgatcgcttccccgtcaagtaaaatttccgctgtccttcccggatgcagcccttcaaatgttgccgcgtggtaggaaatagcgccggaaactccgagtttttcaaacaggccttccaaaatcccttttgccacaaagaaatctactgctttcttttctccttgccacaagttggaaacccaaagcccggtgatggcgccggcgaggtgttcctgttcttccggctgcgctccgtctgcctttttcaaaaagacattgccaacttcatacagggcaaccgactcgtttttacgtgcgacattatacgcgacggattccaaaagatgcggcaaaaggcttaagcgcagcacactgcgttcttcgctcatgggcatagcaacgcggactggttcgcgtttttcaagcgcgtactggtgtgctttttcttcgcttgttaaagaatacgtggttgcctggtacagccccgttccttcaagaaaacgtttcgtggcgcggcgtttttgctgaatgacgttcaagccgccccgcgttcccctgcccgccggcaatgtttttggcagcaggtcataaccgtacaggcgcgccacttcttcaatcagatcttcctcaatcgtaatatcgccgcggcgggttggcacaatcactgtaaaacggccgtcttcccatgatgtttcaaactggagacgtttaaaaatacggagcacttcttccgctgaaatttgcgttccgagcacacggttgattttttccagcgtaatggtgacaacagccggctcaatatgcaaatgattttcggcaaccattccggcaagcacttctccacccgcatatttggcaatcagcattgcggcccgttctgctgcgggcacaacgcggttcggatcaatccctctttcataacggctgcttgcctcgctgcgcaggccgtggtcttttgaagccgtccgaattgttccggcgtcaaaataggcggattccaaaagtacgtttgtcgtcgtttcggatacttccgaattggcgccgcccatgacaccggccattgcgacaggttcagtgccgttcgtaatgacaagatggacatcttttaacgtgcgctcctggtcatcgagcgtgaccattttttccccttcacgcgccatgcggacgacaatttctttggaaccgagcttgtcatagtcaaacgcatggagtggctggccgtattcgagcaaaatatagttcgtaatgtcgaccacattgttgtgcgggcggattccttctgccatgagccgcgcctgcatccagagcggggacgggccgattttcacgttgcggatgacttttaatgtgtaaagcggcgctgcttcttttgcctcgacacggaccgaaatggcatcagcagctttatcggatgcttcctgcacttttgtttccggcaatttcacgtcttttccaaggatcgctgctacttcgtaggcaacgccaagcatgctcatgcagtccgcccggttcggagtaagccccagttcaataatcgtatcatccaatcctaaaagtggcagcacatccttccccacttccacatcatccgggaacacataaatgccgtttgcatactctttttggacgagcttgctttcaacaccgagttcctgcagtgagcagatcatcccgttcgactcctcgccgcgcagtttcgagcgtttgatttttacatgccccggcagccaggcgcccggtttggcaacggcaactttctgccctttatcgacgtttggcgcgccgcaaataatttggacaggctcaccttccccgatatcaaccaggcatttgtttaatttatcggcgttcggatgcttttctttttccaaaacatgcccgacaacgacatttttaatgccttcccccttaaatgccacgctttcgacttcaatcccggtccgcgtaattttttcagccagttcttccggcgaaatgccgtccaaatctacatattcctgcagccatttatatgaaacaaacatgtttgaccctccttattcttgtacggaaaactgccgtaaaaaacgaatgtcatttgtataaaagtggcggatgtcatcaacgccgtatttcagcatcgcaatccgctccggccccatgccaaatgcaaaaccggtatatttttccggatcaaagccggacatccgtaatacgcgcgggtggaccatgccggcgcccaaaatttcaatccagccggtgcctttgcatacatggcaaccgtgcccaccgcacattttgcatgaaatatccatttcaacactcggttcagtgaacgggaaaaagctcgggcgcagccggatttcacggtcttcaccgaataattttttcgcaaacacttccaacgtcccttttaaatcggccatcgtaatgttttcgtcaacaacgagcccttcaatctgcataaactggtgggaatgggtcgcatcatcattgtcgcggcggtatactttccctgggcagatgattttgactggccctttgccgtgatgtttttccattgtccgcgcttggtttggtgaagtatgggtcctgagcaaaatgtcatcggttatgtaaaaggtatcctgcatatcgcgtgccggatgccctttcggcaggttcagcgcttcaaaattgtagtaatcggtttccacttccggcccctcggcaatcgtatagcccatcccgataaacaagtcttcaatttcctcaatgacttttgtaagcggatggtggctgcctgcttttaccgggcggcccggcagcgtgacatcaattttttcagatgccaattgtcgctcgacggcttccgcttccaatgccgcctgctttttttcgatacctgtttgaatggcggcacgcacttcattggcgagcgcgcccattttcggccgttcttctgctgacagctttcccatgccgcgcaaaacttccgtaatcgggccttttttgccgagataggcgacacggatctcgttcagcgtttttaaatcagcagccgcaccaattttggcaagcgcttcggtttgcagtgctttcaacgtttcttccattttcttgtacctcctttaagttttgggcgttaaaaaagccccgtcctggaaaagggacgaggcaatggttcgcggtaccaccctaattaacataattaaattatgttcgcttcatttcaataacggcttttaaccgtcccgcctttacattgcaggcaatggtccaagcggcaactcgaggggtgaacttcgcttcatttccccataaaaatgcttccagtctacggcattttctccctgcatggcgaagatcaagctacttttccctgtcatggtttttatcatttttcaattatgttttattatagcgggaaatgcccgcaatttcaaacggaaagtgacctctctctagatgtttatcttagaggataaagtgccttcccattttagtcacaggcgcggccgttttcacgcgaattttttcgcaataaatgaacgtgttgagggtcacctttttattctggtcaagcagtgcagccgctctcatgaaaacgccctcccccgttccttattggcacccatgctgaaaaattgtcccagctgtttttcatcattctgccgctgcttcacctcatgcattttataggtctgcttttttgcctcaaacatggatacattcactttttccgccgaaattacgaccgcatcgcaaagtcatacattaaaatgccggctgccaccgcaacatttagcgactcgcttttgccgaaaatcgggatggacaaattttgttccgtttgcgcaagcaagtcagggtgtacgccgcttccttcattgccaacaaggatcgcaaaggcatcacctggatttacttcgcgaaacgttacgccgttttcaagcgctgttccgtaaaccggcactgccgcttcgttcagtttttcaatccacatgtttaaatcgccttttaaaagcccgacgtggagatggcttccttgtgccgcacgcaacactttcgggctgtacggatccgccgtgcccttgccgaaaataacggcatcaaacccggctgcgtccgccgtccggatcatcgttcctgtattgccgggatcctgcacggcatcaattaaaagataacgcctgccgatgattttggacggctgttttttcatccggcacacggcaaaaatgccttgcgtcgtttctgtatcggcaagcgttttgctgatttcatgcgtgacagtggttaccggcaccccttccgtattccagcggtttggcaggtccacgccttcttcaacaataatttctgtcactacttcttctttcagcgcttcttcgacgagatggaacccttccagcaaataagtaaatgttttttcgcgttcttttttcgcggttagttttttccaatgctttacttgcggattttgcaaggattgtatgtatttcaacgtgtttgctcccttttcgttaagttttccttggaatagtatacataaaaattgtggccatgtgaaatgctagcagtgaaagtgatcaaaggagctgaaccgaaatggatttggacttgcggaaagcagtcattcacaatgtaaaagaggacacgcaagatcagttaaaagatacgattgtcgatgccattcaaaggggcgaagaaaaaatgctcccggggctcggcgtcctctttgaagtcatttggaaccatgcggatacacaggaacaaaaaatgatgctggaaacgctcgagcaggggctgagccaggcgtaacaagggagcggaaaaagccgctccttctatatgtgcaccggctcttccaatccgtttacagttgcaatgaatgacggcaaatttcttttatgccacccgtaaccaatcagcactttgtttaatcggaaaacagccgtaccatccgaagtcccaacatacaatctgtggtaagtcagcttcggaacagttttcatgcttgtgatcttttctcccggaataaatgccgattcgtccggtaacatattgcccgtaatattattgattggaatgacggtcagcccttgttcactatagctgagcacattatactttgtccccagtgctcccgccggccctctcagcaaataatccgaaaacgatggcaaaatgatcccgcaaaccgtacacttctccgctgttttatcatatctgccagcctctgttaaaaaagcaacaaaatccttttctttcaactcaactttcgcagagtgaaattggcaaataagctttgatataactaggtaggccagagatccactgttccagttgactttgaattaactttttaaatcttttattggtctgttttagtgcgtcttgaagaagctcgattaactgctgcaatgcaacagcccaatcaagttcatttacttcgtcgcaaagttcataaaacagcctgcctattgttctttgatcggtgttgcagcggttttgccacgatagcacgataaaacgtgcaaatacaatagtggtatggctgattaacccatcatacgagcgactttggagctctttttcaagttttaaaagcgattttgtcgtcttaaagaacacttcaatatcccaacgcatcccatagattcgaacaatttcctgttcggaaagggtgcagtccgtactgaggagggcaagccattcacttttcttgtttctgttttgaacgaatataacttttacaggagttccattcgccataacggtacggatagagcgaaggatacccttcttcgactgtaggggttgagccaggcgatagagctgctttaacgaaaccagctttccgtcaacgttatatcgttgttttgtttccttgaccatgccaatcacgtctaaaccttgttccacaatggctttgacaagtggaggcaaagtaaaccaagaatccattagaacatagcttgcatttattccactggcaagcgctcgtttgagcatactagggatctgttcgggttctgactgtaaagcatttttacggcgtttatacccacaggtacgtttatcaatttgttcagagattccattaatctgagccttcttggaactgagtaaagagaagtcaatgggcatgaaggtgtagccgtccgaccagcctaaagttaacatgcgaaatcctttataaaaacgcattttaagagaagcgtggtcaaagcaacgagccagcagttctactttttgactacgatttcgataaaacgatgagtcatcaacaatgaagactttaggacgacttttgtcagtaaggcgttctactttgcgaatagtaaatgtgctcaaaagaagtaaaaactgccgccagttgaacgtcgattggtttaagaaacgatacacggcatccttggctgggaattgatctgctttctttgactcaagaagagaaaaccaattcttgtgttggaaaatcaagcagaaaacaagttgaaacaaataagaacaactaaaaccaaaggatttttttatgccagcatggcgtaagtgcttcttcatttcaagctcagaaaaaacagaatcaagttcttttggtagttgattgtattggcaattttggtctatcatgtagaggacacctcttctatgtggtagtgattttttgtcaatctcactataccaaggaacgaggtgtttttcattttatattcattttgtcaaacaacataatggatagacttaaagttcaatacagccaacgattagcacttattttattggtgcgaaagttgagtttcaacatgaaaaattcctccctctataaatgttgatgtatcaacggtttaagccgttagtggggtgtcaaaaaaatattttttggcacgcttcctaacaaaatttttatattatgtgaaactattccaacatacgggtacgctacgcggtcactactggataataatgggaagtagtgataggaaattatacgatgcacaatggatctctgcgtaacttatgatgacgtaccctcccatgtctctgggcatctgtgtgcctacattccttcgttcggtctagtcataaggcagaggctagcgaagctcctttagggacccgaggtcgaatggaaaaaatagtgccagcttctccgtgtcatcctgttgtctagctcttactaaggatgtgaggccttattcagcctctgcgagaccaggaatatccctcatcattcgctgtgcgtcgaacggtttgtgcttcgtgctaattccgtgtaacacttttaatagcttaccgcatagaaccacaatggattgtttcttgcgtaacggattaacctgacggtttgtgtagtattcatgtagctttctaaaggcttcattatggcgaatcatcggcatcattacccggaaaaggagggcacgcagttttcttctgcctcttttggagatgcgtttttgccctttgtgcagaccggaggagttttcacgtaacgttaatcccgcgagtttaattaattggcgtggatcttgataatgtgaaaagcttccgattccagctaataagtcgacaatcgttgtatctccaagccctggtaccgttgatagccattcgtactctgcagatatttttacaagttcaattaactgccctgtaatactttcgatatcttgttctagctgatggtaacggcggacaagtgtggcaatttcaatacgggccatctcaagtccttctgttactccgatagagccagccgcgacttcaataagacggactgtttttggtctttgaggggattttagcccctcaaccttacgaaaaagggatagaacttcatcgggctgtttctggtaaagatcacttggaaatggtgtgcattcaagtgcagctaaagccatcttcccaaaagacggaaacacctgtacaaactctgggaaatagcgatctaaccaacgaataatcatgtttttgacagcccctaattcctctgtcaatttacttctgaacgtcgacccaacgcgaagttcggcttccatgccttttaagatacgtgggtaactgaaacgtccatccttaactaaacgggcaataaccaatgcatctttgcggtcatgcttggttggcaaattgtcgtccaactcctttgatcgctttacatgcatagggtttaccatgaccaagggaatacccctttcctcaagaaagtaggccaaattgagccagtaatgccctgtgggttcaattcccacaatgacttccgatttctcgtgttctttcattgcggctaaaacgcgctgatagaacagttcaaatccatttcctgcttggggcacagaaaatgatttttggagcactcgcccacggtcatctacaatgcaagcgtagtgtgtacgcttggcaatatcaattcccactacaagtgtttgttcggtgacttgattaattttctaattttgtttaaaatccattatggagtcctccttggttacaaattaggggtcattcgttgtgagatgacaccccgcatcataccaggagggctctttttgttcaagtctccgaaagtccttctaacaggaatgctccttataaatcagttccctttataagaattataaaacttgagtgagagaactttttgttaaacatagaggaaataatagcatcgtttaggaaccttgagttaacagatgatctcttataacctttacaagcatttgccagcactataaacaataaggttttaccctctcacccctgatgattcctgctaaattcagcattggtattcctgtgcgaagaactacccgttaaactcctgtccccggcttccatgagcttcttcatcgccctgtcacatcgcggcggctttcttcaacgagttggagggcttttcggtcgaatgcatggagtttttcattccactcgtctgcaaatttccgtgaagcttccgcgctttcatatagcggtccaagtcaggaacgggaatggatactaatctagggctgcctgccttgtttggctttcctcaagttccatctttgccattttgcggatgagatcacctttttccactatccgctcccctttcacagtaaaacatttccaccgccggcgcgcaaaccggcggtgtttccgtgttaagccgtttttcttcttttcttccttaccgtgagttttctcaaataataagtgagcacaacaaatgcggacatgatgcctgtatatgtgagaaggacagtcaagacattcgcgctgccaccgtcatgatcccctcctcccctgcggtcaccgtctgcaaaatctggcttcttttcatttgcaaaagccggtttctgcccgttcgtgaaatccagcctttgcccgtttgtaaaatccgatttttggccgcttttgccattaaaatcgtgatgcccttccatttcactgttgcccgtgcttccgccaaaaatagaggcggcgcttgccatgcggttcaggaaccctgtttgtatgatttcgcaggagctgaacacaagaatcagggtagcggcgacttttgcaacataacctgcccatttgtttttcgccttgaaatggaccatccttttaaatacattgaccacccagtgccaatgcagcccgacatgcacgccaacaagaatcagcacaaggaaagaaacggaaatatgtgttgttttgaaccagccttcatttccaaggttgatgttcggaaaaacaacgcgtgaaataatgatgccgctgataataatgaaacacatggaaatcagcagcaacagattgagcgcgtaactcccgcgcgctttccacggtaaccttttgtcaaacattttcagcgtaacattttttacccagtttaaattcaggcagacatgcgtcaaaaacacgacgccgaacacaagccctgcaatttcatggtacgcaagtccgcctaaaacatttttgttaaagaacaaaacaaacatgattgccatgaacaaatcaatggcaaatttagcataatttttttcatcttcagctccaccccggcacatttgatatcaaaaatatagtgccatattcttaaattcaacttaaaaacataattttttgcaaaacaacctttgacaaaacgtatacaactgtatacaattacttgtgtatacaactgtatacagaaaggagcacatatatgagatcatcaattggaccgggaggaaaatttgaagggccttgccatccgggtgaagaggaacatggcagaagaaaacaccatcatcacggtgcgaaaacattccgccgtggaagggcaatcgagtttctaaacaggctgaacatcaagcggaacacattgaaagagcagcttgcaacaccggaactgcaatccattaacccggtgattgtcggcgagttaaaggcaatcgaaatggtcatcaacgaatttacagagctgtttgaaatccgcgaagaggaaatcagagagaaagcagccggcgcggaagaaaaatcagataacgaagaaaaaccggacaaagaagaaaaagaggggtgaacaaggttttatgtttgtacaattacgaagaatgacggtagcaaaaggacatgcagatcaggttatcgaacgattcagtaaaccgggaatcatcgaacaacaggaaggctttgttgatataaaaatcatgcagaaaaaacaagggcgcggcgaagaagaagtgattgtcatgatcacatgggaatcagaaacgcactggaaacagtgggaaaagagcgatgtccatatcgcaggacatagggcaaaccgcggcaagtcaaaaccggactatatgctcaatatggaactcggcatgtatgaagtgaaagcggtgaaaaaagcagcaggaaaagcagaaatttccgagtgaaaaactcgagcgaaaagggaaggccggctgtaagcccttttaataaaaagctggcgaaccaattctaatcagagccccaagtagccgaacggagaaaaaatgagactgaacgccaaatagataggccgacccgcattttgtccttcattaatctgatgaaggacattttgctagttgccgcaccagcattttgtctttcatccacccggtgaagaacatttagaagatcgcagcctctcgaactgtctttcatccacccgctgaaagacagttcaagaatcctggccgaccattttgtctttcatctccctgaaagaagatatttcacagtccccgctgtttttttgcaatacctttacgcacaattgcgtgcaacatagttggcgcatgcaaaacccgtggcgaaaccgcacacgggcttttgaacaacagatttattgcacgctagaactatatcccccgggactttgctgctttctcccagctatagtaaacccctaaactcaccacacctaaaacgagcggcaaccaccacggataagaaaaggacgggccgattttcggcatgaatttatccagcaaaataacgccgcccagaaaaacaaagattacggcatctattttcaaaaaagttaggatttgcaccttttttgtcttttccttaaacaaactctttttcaagatacgaaagatataccaaatggcaaagatcacgtatagcccggcaatgaaaaagttcagggccgcgggtacaggataaaacggcggcaaaggtctggaaaagaaccgttcaacaacaaaagcagtaatgccattaatgaccaaatcaatccccaaaagcaagatcattatcctgattgtaaaagaaaccatattgcgtttgttttctttcggcagctgcctgatgatttcgtcggcaaatgctttcgggtcaccgccgaacatttgcgcagctgtcttgttttctttttggccttcgagcagatggtcaagcagttccatcagcacttcttctgtttgctgctcggacaaaacggtttgcaggcgaaggtagtcaagcatatcgttgtaaaattttttgttctcaggtgccagttcctgccgtttacggttgttttcctcaatcaactgttttacactaagcatcctcacttcttcctttcaataaaagatttacaggggctgcgattcgctgccactctgccgtaatctcatccagcgcggattttcctttttccgtcaattcataatatttgcggctcggcccagaatcggatggctgcatctctccatggatccagccgttcttttgcaggcgtaacagaaccggatagagcgtcccctcgctaatttcctggaggcctaattgctgaagtttttttgaaagaatgtagccataaaccggttctttttcaatcacagccagcacacagccgtctaaaatgcctttcagtaactggcttcgaatggacatccctccacccccatttcaactactttgttatgcaagttagtttatcaaaaaacgaactactttgcaatgcaaaatagcaaaaaacaataaaaaaatccagcggcaggctaaccgctggaaaaattttatgattgcttttttcgcttggaaaaataatgaaggaaaaaggacagaatcatataggctaaaatcaaaaatacgacataattggcccaaaagttttcaaggttcaacacattcagtgtgctcagccctttctggatgcccattacaatgagtaccgtcaccgcaaacatgaaaaataattgcacatagcgtttcatagccgtccctcccaaataaagataatcactatgattatcttaaaaaacggtccggccgatgactgtgatctggatcatagcaaagccggttgtttatggcatttatgtgaaaaatgtcgtactccgaaaaagaacggatgctttaaaagatggcgcctgttccatggtataatcaattgggaagaatccttcatttatggaagaggtttttagaaaaccctctctaaaaaactaagaaaacagcatcccttttcggtgctgttttgtgtgaaaggacgattatcaatgaaaaaagaaaaagcagtcgttgttttcagcggcggccaggacagcaccacctgccttttctgggcaaagaaaaagtttcaggaagtggaagccgttacgttcgattacgggcagcgccaccgtcttgaaatagaatgtgcaaagaatatagcggaagagctcggggtaaagcagcatattctggatatgcagctgttgaaccaactcgccccgaacgcgctgacgagggaaagcattaccgtgaaagcaggggcagacggggagcttccgaatacgtttgtgcccgggcggaatttgctgtttctttcttttgccggggtgcttgccagccaaatcggcgcaaggcatatcgtaaccggtgtgtgcgaaacggacttcagcggttacccggactgtcgcgatattttcatcaaatctttaaacgtcaccttgaacctttcaatggaccagcagtttgtcattcataccccgctcatgtggcgtaacaaagcagaaacatgggcgctcgcggatgaactcggggcatttgattttgtccgtgaaaagacgctgacctgctataatggcatcatcgctgacggctgcgggaaatgcccggcgtgcaaattgcgcaaaagagggctggagcaatacctggccatccggaacgggcagtctgaatgacgatttcgttggaattgtggtaaaataatgaaaaaaggaggcgggggaatggctgaaatcaaaacagtatcgatcattgggttaggcgcgctcggtattttattcgggcatcatttatcgaaaaaaatgccggcgaaaaacttgcggatcatcgctgaccaacagcgcattgaacgatatgagcgggaaggcgtttattgtaacggcgaaaaatgccactttcattatgtcacaccggaagaaacagtggagccggcagatttggtgctatttacggtcaaattcaacggactggacgaggtagttgaagcagtcaaacaacatgtcgggccggatacggtgattttgtctgccttaaatgggatctcaagcgaagaaatcattggccgtacatatggaatggacaaaatgttatactgtgtcgcccaggggatggatgccgtcaaaaccggaaaccagctgacatatgcgcatatgggcatgctttgcttcggcgaaaaagagccgggccttttttcggacaaaatgaaaaaagtggcccgcttctttgagcaaacggatttgccatacgaagccgataccgaaatgatgaaaaggctttggggcaaattcatgctcaatgtcggcgtcaaccagaccgtcgccgtttacaaaagcaattacggcgaaatccaaaaagacggccctgcacgcgagatgatgattgccgccatgcgggaagttgaggcattgtccgaaaaagaagggtttccgcttacggaagaagatctccgttactggctgaaagtggtcggaaacctgagccctgccggtaagccgtcaatggcgcaggatgtggaggcaaaacggtacagcgaagtcggcctgttttccggaaccgtcatcaaactcggcaaaaaatacggcgttcaagttccggttaacgaggaactgaaccggcgcatccgggaaatcgaaagcacttataccgcagtacattgacacggatcaccaaaaaggggagctttcaggaaagctccctttttggtatggcatacaattgcctgctgtttgtagatggaggctagggaaggcagtcatagaagcgccctatatgaagaaaggaaacttttttctgcgtttccttaacttagaggtcctctatgtgaaggaagagcctcgtttttgcttgcttccttaacgtagacgcgctctacgtgaagatagaccgtcttttttccgcgcttccttaacatagacacgctctatgttaaggaacaacctcaatttccttcgcttccttaacgtagacgcactctatgtgaagatagaccgacttttttccgcgcttccttaacatagacacgctctatgttaaggaacaacttcaatttccttcgcttccttaacatagacgcgctctatgtaaagaaaggactcattttttccacgctttcttaacgtagacgggctctaggttaaagaagaggaccattttccttcgcttccttaacatagacgcgccctatgtgaaggaaggctgccttttttccacgcttccttaacgtagacgcactctatgtgaagaaagaccctcaatttcccccgcttcctttacgtagacgcccatgccgcaaagaacatggcgttagcagaaggcaacgcgacttgccagaatcacgcacggctacatgaaggttccatagataattgccgtcttccttcattcgtcgtccttgctgcaaagaacgcggtacgcaagaagaatgaagcgtgactactttcgtctgctgattgaatgcgtgaaacctaaagggcaaggcgttttgtatttgcctcgtgggccatcccgttaaaaccgaaaatgtttgggcaaaatcggtcctttatttttgattaccataaggaagactggtcaatactttaatcggggaacaaaaaaccgggaacaaccattgaccttcgattgcttgtggttgtcaccaagaacatccggaaaccgccagccggcttgaatggtacatagcaacatagcaagcaggaattttgactttccggtgcggttttcttatcattatctagcataaaatataaatggaagcaggtcgataaaatgacgaaagttggaattttgcttggctctttgcggaaagcatctttttcaagaaaacttgcggaaaatgtggcaaacctttttcctgaaggatatgaaacggaatttgtcgagattgggaacctccctttatataatcaggattttgatgaccataaccaggttccggccgagtatacgacatttcggaatacagtaaaagggctcgatgcggtgctgtttgtaacaccggaatacaaccgctccatcccggctgtgttaaaaaatgcaatcgatgttggttcgcgcccgtacggccaaagtatatgggatgggaaaccggcggcgattatcagccaatcccctggaaacttaagcgggtttggtgccaaccatcatctgcgccagtcgcttgtttgtctgaacatgccaatcctccagcagcctgaagcttatatcggcaatgttactgcactgtttgatgaaaacggaaaaattgtgaatgaaggcacagtccggttcctgcaatcatttacagatgcatttgttgatttaattaaaaaatacaaaggctgatgtacccatcggaagctgaaaaacagcgggatcccttttccaaagggttcccgctgtttttcgtcattgggcctttccttgattgtttaaaagcagggggaaattttactttattttattttccccattaaaatttttctccttttgccgatcaatttattagggattccgcaagcaacaaaaagattaaatcttttttaagtctttttttctatactacatacagatttaaatggtggaggaacgttatgttaaagaatgttaaaaagatttcattcaagatcattatgctctcagtgctcaactctgtgattgtgattgccattaatattggggcatcggtttacggaaatatcggcaagggaaacagcggcaccggaaaccacgtgcccccggccggaatcgcaatcataccgacaaatgttttaatcggtcttttcatttcccttatcatcggtatcattctttcatacatactgggtagggtaatctcaaaaccgatcctgcaaacggccgaactggcagaacagacagcggcacttgatttacgggaagaaaatgggtctttcgataaaattcagtcttttcaggatgaaacgggcaagcttgccagggcgctcaggcaaacgagaatctctttaagagaagtggccaaacggttgaaggaattttcatcaaaggtcgctacccatacggataccctctcaaaaagaacggaagaaagttttcaatctatcaatcaagtagcctcttccattgatgaatttgcgcaagggaacagtcagctgtcagaaaccgtccatgacatcaataaaactttaaacgaggtggtcaatctcattgaaaccattacgcaggaagctgccaacggggcagaacatgcagctgcttcgcttgacgccgtaaaagaagggcagaatacgattgaccatcagttcaaaaaaatagatcaaaatattgaaatcacagcgacggcaaacgagtctattacagaactgagcgggatgatcgaccaggtccaggcatttgtcaatgttatcacttccattgcagaacagacgaacctgcttgcattgaatgcttccattgaggcgagccgggccggggatgccggaagaggttttgcggttgttgccggcgaaattcgcaaactggcggaaggatcatcaaaagcagcccgggaaattaaagacctgatcgccacgacaacgaaaaagtcgaatgcagctgttgaaaatattagcaaagcaaacgcctttatacatgaacaaaaagatgcgttccacaaaacggaagctgcttttcatcagattcaacatacttacagcaacattgttggcagttttcagcataccgcagaagggattgaaacgatcaacgaaaaatcaaaacaaatttcgaagcggattcaggagataacttctacagttgaaaattttgcggcaagttccgaagagatgtctgcttccggccaggaacagcgggcctttacagagattatttcacaatcagcgaaagaattgcaagagctggctggcaagctggataccgaaatgaataaatttaaagtcagctgacgataaacaggcagtgtgatcaacatgcaagatgtgaccacactgcctgttttgatgttcatatttgaatgggaatggatcaaatccggcaaaaatcaggaatgttcccgcttggggtacccgcaagtccggcagcgggcgcttttagaatcatgcttcatgcattctgacaatgatttttcctcgtacgtggcggccttttaaggttttcaaaccggccggcagttcctcacgcgggagcacttggttgaccatcggattcagcgtcccttttttcacacgctgcatcaattcatccgccataaaagccaggttttgctttgcccggacggagccgctcgcatgggctgcaccgagggcgacttcatgaatcgatggcgcaagcgtgaacggctttatgccggataagtccggggcgcctgcaatatatgcgagctggccggaaaaagcgagccgcttcaaatcttcggtcgcttcggcgaaactgacagtgttcaatatcaggtccaccccttccccgtccgtctcttccatgattctttttgtgacatcttctgtatgatagtctatcgctgtatctgcaccgagcgatttgacccattcgtgattggcggcggaagcggtggtgaatacttttaacccgagttctttcgcgagctgaatggcaaatccgccaactccgccggcgccggcatggatcaaaatcgtttgcttgtcagtatggtttaatttttgcaccactgcctgatatgcggtcatcccggcacaaagcacagctaccgcttcgtcataagaaacgccatcagggatttttgcggctgcatttgcatcaatggccgcaaactgtgcaaatgcccctttccggttcaaatcggtgtggcatgccaccctgtcacctgttttaaaaccagacgtatccgggccaacttcaacaacttcccccgcaagatcgacaccggttatatgcggatacacccagttcggattgccggattcaatcaattggtagtcaaccgggtttaaagcggtgctcatcactttcacaacaagctgtccttcacctgcacgaggatccggcacttctccccatgtgaggtcgtcaatgcttgcaggtttcccgataagccatcctttcaatttccggttcctccttaataagcgccttctgaatatgtcaattcataactgtggctgtaaatttccactaagttgccgaacggatcttcgcagtaaaccatccggtaaggctttttccccggataatattcacggatcggcatccgttgtttacccccgtgcgcttttattttttccacgaggccttctacatccggatcctggacggcataatggaaaatgcccgttttccagtactcgaagttattgtcaggtgtttcattgtttttgaactcaaacatttcaacacctgttccgtcgcccattgccaagtgtgcgatgcggaacgacccccagccagagccgaaaacatctttgcacatgatgccaatggcgctgtcgtcttctttaatttcagatggttccatgatcacgtaccagcccatcacctcggtataaaattgaacggctttgtccaaattaggaacggaaaggccgatatgtgaaaaagatcgtggatacgtcatttttttatcactctttttttggttactatactagtatagtatgcgacaatccattttaaaaatgagacgcattttttcttgatcctgttcttgaacatttacgcaggcccattttcattcttttaccggttccaatccgtttagaaatggctcggtccatgtcctctcccgcagcctattctgtggacccgaattcgcctttccctcttttggattcagctaaccgtttccagggcgcgatcgtcatttgggcaattcgtaaccttttttccactttgaacggatttctcatcctcaacctatcttgaacagctagccggcaaatctgcaaacgctcctgaaaacatctgtagggacgttttttgcctgttggaaagcaagtttgatcatgcagtgccacttcacacgacagatatgcttgtccctctattcgttttctttatccggtgttttatcactcagctctttgtccggcgttttttcgtccggtttgccccgattgttcctgacttcttttttgcagatttcaaatggctctgccgtttcatggaccacggattcaatcgcttttatttctcccgtgatggcccggctgatagactgcagttccggtttgggaagctgccgttttaatacgttgcgtttgacgtttagcctgtttaaaaacgcgacatgcggctgaaacattcgctttgaataccactcccagtaggataaaagcactactgccagcatcccgatttggggcgagaaaactggttcatcgagaaagccggtcaggacgattaccggcaggctgagcagaaaaatgttcaagtaacgataatttctttttatgaaaaataatctgcccaatttgcacacccccatggctaacacagcaagaaaagcaataccgccaattgccccgtattcgacaaaaaaaccgataaaaatatcatgggcgtggtaaatatttttatggaacaggctggcatatactttcccgaaaccaagtggtgttgtgccaaacaaaaagtgggtttcaaaaattttataggaatgataccagatcttttccctgcccgttagagaaccttcaatggaatgaactctcgggatgaccgccgcaagcttgcctgctccgagcgccagaaacagaagcccgcctccaaaaatccatttattccatctgaaaaagaaaataaaataaatgcatatcatcgaaataaaaccggcccgtgatccagtatcaaagacgcctttactaaggaaaaaaagcgggatacatttccaaatcaagtttttccagtctttcttgcccgcgtctttcagcatctccgcaaacagaaatgaaatcccgatcagtagcagaaacatcgtgaaattcggattgtaagtactgccgattaatctgttgtaatgtttaaaaccgaacagctccgtgccggtcagaaatgccagcactgggtcatccgacaacatttttggaagccagccaatgaaaataccataaaggccacagccgatcacaatccagcggaaatgcttgaatctgccccttgttccgctgtccataattttaaggaaaattccccagtaaaacaaaatccttaagctttcagcaagaaggagcggttctcccatttgcacagccgctccggtggttgctgccaaaagacagagaaagaaaaaggagacaggggaagatgaaaacaaccgtttatttttgatatgcctgtacagttccgaaaggctgaatacaagcatgataaacagaccaacaggcgggagcgcaaaacacaatactgcagccagttcaaatgcatgctcttttataaagtgtattaaactgttcataggattcctcgttattcggatctaattgctcaggaaccactataccatgcacagattaaatttcgttgaaaaaatctcatgaaaagaaattttatttttcatttattttggcaatcccagtggatccgaacccgccttcccctctttcggattctgctaactgttccgtaacacttacggtgacagacatgacgggtgcgataatcatttgggcgattcgcatccctttttcaactttgaatggcgtctttccaaagttgattaaaatgactttaatttctcctctgtacccctcatcaatcgtacccgggctgtttaaaacggtgaccctgtgttttaaagcgagcccgcttctcggcctgacctgcgcctctgttctgcgcggcagctcgatggcaatgccggtacggatcagttccgcttcccccggtgcaatgtttttttcttcgatggaatataaatccaaccctgcatctccaggattggccctttgcggcagttgtgcatcaggatgcaataattttacctttaaaacatcatccattgaaatcgctcctcgtatagttcttccatgattatatcaaactaaaacaggtttttacttttttccgggaatccggaaattttttaccagaagggggactattcttggttaaaatgacgaaaaagatgccaaaaattccggcagagcctgaaatgacaatcgcatccgaccaaaaagaatttcagccgggcgagtcagtggacgaacatgccaatttggaagctacaaacgaaactttgaaccaggaagaaatcagacagcagacggaaaatttataatgctttttttaaaaaacagagcccccggcatgccggaagctctgttttttgattataatgctgcttttgctttgtttgccagttcggcaaatgcttgtgcatcgttcacagcgaggtcggcaagcattttgcggttcacttcaatgcctgcctgtttcaaaccgtgcatcaaacggctgtaggaaaggccattgattcttgccgcagcgttaatacgggtaatccacagtttgcggaaatcgcgttttttctggcgacggtcgcgatacgcatacatgtaggatttcatcacttgctgattggcaactttaaataatgtatgttttgaaccataataacctttggctaatttcagaacttttttgcgtcgtctgcgggtaactgtaccgccttttacacgtggcataatcttttcctcctaattgaaagctttgttttcttacagattgtcgagcatttggcggatgcgtttcatgtcgctttcggatacaagcgttgatttacgcagctggcgtttttgttttgtcactttatttgcgaacaaatggcttctgtaagcgtgggaacgtttcaggctgccggagccggttttcttaaaacgcttggcagagccgcggtgtgttttcatttttggcatgattagtcctccttaagttgacgttacttcttctctgtttttggtgcgagcactaagaacatgctccgtccgtccattttcggtttggattcgaccgtggcgacttcggcacatgcttctgcaaaccggtcgaggacgcgctgcccgatatctttatgggtaatggcgcggcctttaaaacggatcgaggcttttaccttatcgcctttttccaaaaacttaatggcattgcggagttttgtattaaagtcatgttcttcgatggtcgggctcaaacgaacctcttttacgttaatgattttttgctttttccgtgcttccctgtcttttttctgcatctcgaaacggtattttccgtagtccatgatgcgggcaacaggcggttttgcgtttggcgcaacaagtacaaggtcaaggttggcacgtgccgcaatctccaatgcttcgttccgggatttaactcccatctgttcgccgttttggccgattaaacggacttcgcgggcacgaatgccttcgttcaccatcatgtctttgctaataatgagccacctccaagataatttcaaacaaacgtgtgaatatttcgcttgcgaaaaagccctgaacgtactgcacacgaaaaaaagcgcagggaacacacccgcgcttatgatcacgatcattgatagatacctgacaactgcaccattgcgtcaacaggtgagaagcgggctgctccttcttttcacaaacttatattcaatttcactcaattattgtatcactttaccgtatccatgtcaatttgcaagaatcccggaaaatctgtttaactttttttggctcaacatgcgttattttatcaaaacggcagagaaatcgcaagtgtttttttggtctcctctctgaagtgcttaatgaaaatgcttgtctttgttgaaacaaaagcttctaaaaataaagcttttacatcaagcctgagcatctatttacatgcttttttcggtaggcaagagagcggcattttatataaaatgaacggaaattggatcaaatgtaaatcaatttttcattttcccctcctaaccatgctaccggtttcaatccatttttctgaatgatggttgtaccttccatttatctccttttttatctacttaatttcacatacgtatggtcaatctccacaacttttggcagttttctcattcttccgcttcccatataaaacagtgccaggacaaacaaccctattccaaaaaagctcatggtaagctggacagaagtgatcttggccatcacgccgccgatcaatgatcctgccggcatcgcaagcgatagcaaactcacgttgatggtattgacccgccctaacatttgttcatcaggcaattgctgaaatatggcagaaaacaaaacattgatggcaccaatagataactcggaaataaacataagcgtataaacataccatatcgaaacattgctcaataaaatcatgaaaagccaggacaacccggagagcaaaaagcctgcagccaatattttgccaaacggaaatatccggctgattttatccgcgcctgccgctcccgccaaagcccctaaacccaaagccgctgtcatgatgccgtaggatgaagcgccttcgcccgcagtattggcgaaagaaggcaatacgaccattacaattgcgaaaaaaaagtttaaaaacagcaaggggattaataattgcaagatgaaaggctgtttgacaaacgataggccttctttaaaatcccgtttgtacgcctgccattcttcccgtacgctcccggtttgcttgcttctttttacctgtacttttaaaaacaaaaacagaatggatgagagtataaaaagaagcgaattcatcccgagcaccatcgacatcgagaaagcggcgaggataaacccggcaatcccattaaagaaaaaatccgaacccttatatgcaatggacatgagtgaattggccttgacgagatctttcttttccacggctttcggcaataatacgctttctaacgggtaagtcagttccgataaaaacgaaagaaccgggatggaaagcaacagcagccagacattcatgatgccagacttgcttaaaacaacaagaaaaagcagtaagccggcttgtaaaaagcttgctgtaaccagcaatttttttgcatttattttatcaagaaccgggccgtaaaataagctcagcacctctgtcagcgaaaataagaatccggcaaatccggtatagaccgtcgagttcccccctaattttaaaaccatccacatcatggcaatataataaacactatccccaatattggtgaacagcctgccaaaaaacaacgcattaaaatgacgattccgaaataagtccattaggctccgtccccttcccctgtgccaacccattttttcctctattatataataaaaagcaccctgcaaacctttttgtggtctttagggtgcgtgatttcttgtctgttttaccgttttatttcttcttttatcttgctgaggaatgtgtccaccggcaccgtttccgtttgtttctcgccgtatttgcgaacattgaccgcattgtctgtggattcctggtcgccgacaacgagcgcgtacgggattttttgcacttgggcttcacggatccggtagcccaatttttcatcgcgggcatcaagttcagcgcggaccccttccgccttgagcgcttcttggactttccgcgcatagtcataatgggcatccggtgataccgggatcacttgtacttgaatcggcgcaagccatgtcggaaacgcccctttgtattcctcgatcaaataagcgacaaaccgttccattgtcgagacaacaccacgatggatgacaaccgggcggtgcggcttgccgtcttccccgacatacgtcagatcaaatcgttccgggagcaggaagtcaagctgcacggttgacaatgtttcgtctttgccaagcgccgtgcggacctggacgtcaagcttcgggccgtaaaatgcagcttcgccttccgcttcgtaatagtcaaaaccaaaatcatccatcgtttctttcagcatcgcctgtgccttgttccacatttcatcatcatcataatacttgtccgtattttccgggtcacggtacgacaggcggaacgagtagtcggtaatgttgaaatctttatatacctcaagaatcagttcgactacgcgcttgaattcttccttaatctggtccggacgcacgaaaatatgggcatcattcaatgtcatgccgcgcacccgttgcaggccggagagcgcaccggacatttcataacggtgcatgagcccgagttcggcaatccggatcggcaattcgcggtagctgtggatcgtatttttatacaccatcatatggtgcgggcagttcatcggacgcaacacgagttcttcattgtccattttcatgaccgggaacatatcttcctggtaatggtcccagtggccgctcgttttatacaggtccacgctgccaagcaccggcgtatagacgtggtcatagccgagtttgacttccttgtcaacaatataccgttcaatggtgcggcggatcgttgcgccttttggcagccagagcggcaggccttgtccgactttttgcgagttcgtgaaaagttcaagttctttcccgattttcctgtggtcgcgttcttttgcttcttccaggaatttcaaatgggcttcgagatcttctttcttgaagaaagccgtcccgtatatgcgctgcatcattttgttgttgctgtcgccgcgccagtatgcaccggcaatgtttaataacttgaattccttaatttttccggttgacggcacatggacgccgcggcacaggtcaacaaattcgccctgttcataaaccgtgaccgtttcgtccggaatcgcatcaatcagttcaagcttgtattcatcatgtgcaaatatttttctggcttcgtcacgggatacgactttgcggacaatttcaagattttccgcaacaatttttttcatttccttttcaattttcggcaagtcttccggcgtgagtgacacttcaagatccatgtcgtagtaaaatccgttttcaattgcagggccgacaccaaacttgacattgccgtacaggcggcggacagcctgtgccatcaaatgtgccgtgctgtggcgcaagattccgagcgcatcttcatgctcaggggtgacgatttcaattgcgccgtcttcttcaatcggtgtgcgcaaatcgagcagtttgccgttcagtttgccggcgagcgcctttttcctgaggcccgggctgatcgattgggcaatctcttccgttgttgttccaaatggaaattcctttaaagcaccatctggaaaagtgatttttacgatctctgccatatgtcccactcctttaaaaattaagctgtcacgcgggcggcctgcacgaggctgctttttgcaggcatccgtacgagcacgtccgcacgaaaacacagccaaaaaaataaaaaacccgcccccggcaagggacgagttttgtacacgcggttccaccctcatttccgcacgtctttacgcgcggcttgagtatgataacggaaatatccgtcagccgctactgattttgttcacgactgaagttcggaggcggtaagcatcctgtccgtgccggaaagcttgcagcctgaggctttcctctctgaaaggcggtaacagaatcctgttgtcctcgtcatcacattgactttttcatttccaattgattatgtaagtaattatagaagtttgcaatgaaaaaatcaagggatggcgattgattttgttgccgtgctgcatttgcccccggttcaagccccctttttattcactggcggcgaattgatcgtgcataaaatgcatccggcttttcacggccacccgttcttcaaaaatattgcatatcgtacgaatcaaagcctggtccggcgtatccgtataaatttcaatccggctgggcgcaatcgataaaagcggtgcaattgtgactgagtcaatatagacagggtggttggacagaagcctgcggtcaatcaatccgttcagttcttccctcgtcatttcccggaattggccgttgtaaaatttcacctgttccccgaggcaaagctttattttttccctttttggttctttttgctttaagtaatccctaaggctttgcacaaaaatctggtattcctgttccattttgtattcgtcaatcgcaatgccgatgtatcggtcaagacagtcaaaatagccttttaagcggaacgtcagcacggaagcgagcggcaatgtgcacgattcgccaaccagcggtgcgaccgctccttcaatagcggcgcgttcgtcgatctcacccgccagatccgtcagctccggccgctctcctttcagcatgccgtctacgatttcgagtatccggttttgctcttcttccgcctgaaaaaaataggcttgtttcagttggttacaaatccactcgtttctttttttcttcatgatgaaatttgcaacggctgcctgcagttcctgtttattgccggccgcttccacaacataatgtattttcccatgcagcactgcttcccggattttcacagtgcgccgtttttcctttgcaaaatatgcttttatccataatgcatcatccttgtccctgatcaggaattccaatccaagccccccctgtacggtaaaacattctcgtttgctttaccttatgtatatgaagcggcatcagcaaatagaagacgggaaagcgttacgaaatgaaaaaggcgggccccctcatgcaagggtcaggcccgctggttcggcccctccatccggacaggggcgcttaaatatttgatgcgctcgagaatgcgcgctgctttcaattcttccttttccccgcgctgggtataagtgaaatggtactctaaatcctcatagctgaaattggatgtaaaaaaagtgggaaggtcttcctgcatcctgtattggagaatcgggccgagcacttcatcccgcgtccagctcgagttcgtttccgcaccgatatcatccaacatcaatacgggcacttgcttcaccgtatccagcttttccccggtggagtggtcgccgatcgagtccttcatttcgcggaaaaactcaggcacatacacgattaaagaagagacctgtttccggtccgccagctcgttcgcaattgcaccaagcaaatacgatttgccgacgccgaaattgccgtataaatatagtcccttcatttttttgcccggctcgtattcacggacaaagcgatgcgcaaaatcgtatgcatcaagacgccccatttgttcaaggaaaaaatcaccaaaggacgcctccaatatttttttcggcatgtgcatgctttggatcagcctgcgcgttttattgcgctcatcctccaatattttcttctggcaccttttatagtggatctcaatattgccatgttcaataacgagttccggcacataccctttcatcatattcacgcattcgccaaggcttttgcaccggctgcaatttttttcctgtgaaatgaattcgtacagtttcatccagcttttttcaatcatcgattttgtgacttcaccgtggtgtgcatccaaaaaagcgcggatgtcgggatgcgtgatgatttcctgcttcatttcttcataacgcttgcggaaaccgggattggatgaaagccttttgagtgtctcatttatgttttccaccgccttcaccctttcttgtattgttcacgtattttttcaagcctttttcttttttcttccattgactcgccatcggcttggaccgcggtcgcagtggttttttggtcttcttttttaaaccagtccggcagcttttcaacccggaccggctttctccgtccggtgccgttcttctctttattgttcagccattgtttgtactggcggtcttcttttttggcaaacgccatcgcttccttggcggttttcagttttttgcgcgcccaatgggaagccactttttctaaataatttttcgacagcttcatatcggttttaaataaaacatattggattagtacatttacaaccccaaggggaagctgctgggcaaacatgacttcttcaatggcggcaagatctgctttcgccggttcgctgccgcccgaaaaatcgatcagcatttgtctcggagaagtcgtttccaggtagcggaggaatttctcctcatcgttttccggctctttttgttctttcgcatccgcttctggctggaagcggtcaacaaggcgtggcagttcgtcatgatgttcaatctggtaccagctgcgcgcgattttccgcaaatcctccacccggatttccaagtctgccgtcaatgcctggagcaaaattttctttatgtccagctcatttaaaccgtataaaaatgaaagcttcacaatcgcttctctgacttccggcgtaatggcacgcagcggaatcagttcatcacgtaagtttgcatataaaaggtcaaaattaaaatgggtgttttcgatttttatgaccggggcggcggttttttcgatatagcggcggttttcttccagccggctgagttgctgcgcttccgcctcattcagcacttcggggccgatttttgcggcatacacatcctggaatgagcgggtgatgtcccggtactcacccggttctacggcgcggtcggagaagaagtgtttcaaccgctggaaatgtgttctgccgagctgccggtacaggaaaacatttaacaaaccgtcgttgaaaaactgttccggggacaggggcggctgcagttcgtatataaacatgcggatgtcgtccgtttgtttcatatatgttttcaaaagcccaatgccttcaagcttcagccgggcttcgtaaatttcagacaaattcatggataaaaagcccatcagatggtaatggttccagtcttcggaccagagccggccgacttccacttcattccataatgtcatatacaggctgtaacattgcggcccgattaacggctggtacaggagcgaaatgaccttttgatcgtagtcctgaagcaggccgtttgacgatgcacgataacggtcagctggctgtatttcattccaaatcggtttcataaaaggcactccgtttaagcattcttgttgagcaattctttcagttcatcgagaaaaacattcaagtctttaaattggcggtaaacggaagcaaagcggacataggccacttcatccactttcgacagcctgtccatcaccatttccccgatcagggtggaactgacttctgtatatccttgcctgcggatttctttttcgatctccatggagattttttcaagctggtccagcgacacaggccgtttttcacacgctttaatcagcccgcgcaaaattttctcacggttaaattcttcgcggttgccgtcttttttcacgacaatgagcggggtttcttccactttttcaaacgtggtgaagcggtacgagcagtcttcgcattcacgccttctgcggatggaacggccttcgtccaccggccttgaatcgatcacacgcgtattgttgctatggcaagacggacatttcatatgaaccccccgttctgatacattcttactaccatcatatataaaagaaggcgaatagacaacagaaaggttcatcctattcccgaaagaaattcatccatgcagaacatattggatgtatcttctgtttgtatatccggaaaagtcctcactttcatctatccatcaatagaatagaaaacacttctatttcgtcagcgtcccgcagcaagtcatcctccggcgcggctctgaaaactggtaacgaaaacggagcaggctggtgctgctccgttcggcttaggcaatattgattttcccggtttcttccattttttccgcgacgagctgtgccagttgtacgacgcggcaagaatagccccattcattatcgtaccaggccaacaccttgactttgcttccatccatgaccatcgtggataagccgtcgacaatggccgagtacggatttgtcgtataatccgaagaaacgagcggcacttctgtatagtccaaaatgccttgcagcgagcctttcgccgccgccttaaatgcatcattcacttcttctgccgtcacttcttttttcaaatcgacgacaaggtccactagcgatacatccggggtcggaacacgcagcgccatgccgtgcagtttccctttcagttgcgggaggacaaggcctaacgcttttgccgccccggttgtcgtcggaatgatcgatttgccacaggcccgggcacgccttaaatctttatgcggattgtcgatattgttctggtcattcgtataagaatggactgttgtcatcaggccgtttacaatcccgaattgttcatcaagtactttcgcgaccggtgccaggcagtttgtggtgcaggaagcgttcgagataatatgatgccgctcgatatctaaaacgttttcatttacccctaaaacaatcgtgacatcttcattcttcccgggcgctgtcaacagtacttttttcgcgcctgcctgaagatggagcgcggctttttcccttgcattgaattttccggttgcttcaattaccacatcaatatccatttttccccacggcagttgggccggattgcgttccgccaaaagccggatgcgtttgccgttcacaatgagtgcttcctcttcttccacttccacttctccgggaaatacgccgtggatggagtcatatttaatcaaatgtgctagtgtttccgccggatagcaggcattcaccgccacaatatttaaagcgttatccatcatggcttttctgaaaaccattctgccgatgcggccgaaaccattaatcgcaatttttgtttccacagtgcagacaactccttcgaataataaatgacatacttttaatccattattcatcaattagtatatcatattttaaaagttatgtagcgttattcccctatttttgcataaaaaaaaccatgatgtacccatcatggaacgagctgccaatctgacacgattttttcaagctgctgttttgtttcctccaggctgccattgttgtcgagcaccgcatccgccagtgcctttttttcgctcagcggcatttgcgcccggatccgcatctgcgcttctttttctgaaaggccgtttcgggtcattaatctctttaactgcgtctctccatccacgtaaacgaggatggtgcgttcaaccatataggtaagccggctttcaaaaagaagcgggatatccagaaagacagtttttttcccattttcaattgcccggtccttttcccgcgtcatccaggcccggactgcagggtggacaatgctgtttagtttcatccggagtgcttcatccgcaaaaatgagtgccccgagttttttccggtcaagcgtgagatcttgcagcaaaatcccttcgccgaacgcttcaatgatttgttcatacgcaagttcgccgggttcgaccacttttcttgcggcaatatccgcatcgacaatcgtaaacccttttgttttcagcatattggacaccgtgcttttgccgcttgcaatcccgcctgttaagccgataatctttgccatactcccacctgccttgttaaaacttgcatataccgatcaaaatgaggagaacacctggtataaaggaaattttccggatccattgcagccgggaaaacagcatgccgagccggatgccggaagagacaagcaaaaagctcatgccggcaacaaggaaactgagcagaaacggggagtagcccatgatgcccgcaccgatcccggcaccgaatgcatcgagcgagagcgcaatcccaagcatgaccgcttcgattcccgtaatggccccggaacggtcaaaatccgcgctcgtcggttttttcaaaatatggatgacgacgcccaatgagcggatttcaaagttgagcacgaccttttccccgggttcttctttttcgtcgtttgaccggaaaaactggaccatcacccatgccccgatcaaaattaaaatcacgccgccaatccggtttgccgtttccgggcgaatccaatggagtaggctcttcccgaacagcacggaaagaaataaagacgcccccgaacaaacggcgatgatgaggagggacttaagcggaatcttcatcttccgcagcccgtatgtaaaacctgtgctgaaattatccatgctgaccgccaatgccaatagcaaaatcgaaagccggaaacccacggccatcgccccttccgttttgcatcgctgctattagtgtatggagggggcctggccaatgttcaacctgttatctgcgtttcttttggcaattcgggcagtaatgggtgccgcggcctgctgtaaccatcttttcaatcggggtgccgcatttccggcacggctcccctttccggccgtaaacatacagctcgagctggaacatgcccatctgcccttgcgaattcacataggaacggaccgtgctgccgcctttttcaacggcttcctgcaacgtttggacgatctcgctgtgtaaaagatgtacgtctttttttgtcagtgactttgctttccgctccggatagatgcgggcacggaacaaggcttcgtccacataaatattcccgagcccagaaatgaccgtctgatcgagcaaacaggttttgatattgcgttccgttttctttaatttgtcgtataaatatttttccgtaaacgcatcggataacggctcagggccgagttttgaaagcgggagagaggacaattcctccccctttaaaaacaaatgcatcgtcccgaatttgcggacgtctttataccttagttcctttccggattgaaaatgaaaaatcatatgcgtatgcttttcaaccggttcattttggtcataaacccggtaccgtccttccatgcgcaaatgggagacaagcgcgtaatggtccgtgtaaaaaatgagaaatttgccgcgccgcccgagcgaacggatcgtttcaccggccagagcatcggcaaacgcctctgtgtgaagcggctttttgaccatttttggcaaaagcaccgttacgctttcaatcgtttcgccggcaacgagctgtgccagcgttcttcgtatcgtttccacttccggtagttccggcatgcttgattcctctttcctttctttgttgcctgcagctattttgcatcaaaccaggtcggcccgtatgcggaatccactttcaggggagcggcaagatctacggcatgctccatcacttccggcacaatttctttcagcacttcaatctcttcttccggcgcttcgaaaatcagctcgtcatggacctgcagcagcagccgcgcccgcagtttttcttttttcagcctttttgccatatcgatcatcgcttttttaataatatcagctgcacttccctggatcggtgtattcatggccgtcctttcagcaaagctgcgcaagttgaaattccggcttgtaatttccggcaagtaacgccgccgctttaaaagggtggagacatagcctttttgcttggcttccctgacaatttcatccatatattccttaacgcgcgggtaggacgcaaaataccgtttgataaattcgccggcttccttgcgggaaatgccgagattttgcgaaagcccgtagtcgctgatgccatatacgatcccgaagttgaccgcttttgcctggcgccgcatctcagacgttacttcttccgctttcacatggaaaacttccatcgccgttttcgtatggatatccatgccttcgcggaacgcttcaatcagcttttcatcgccggaaatatgggcgagcacccgcaattccacctgcgagtaatccgatgaaaaaataagccagccttcttccgacgggacaaacgcttgacgaattttccggccttcttccatgcggatcgggatattttgcaaattcggatccgtcgagctgaggcggccggtctgcgtcaatgcttggttaaaacgcgtatggactttgccatcttggtggaccacttttaagagcccctcaatataggtggactggagtttcccaagctgccggtaatgaaggatttccctgacgatttcgtgggcaggctccagtttttcgagcacatcggcagacgtggagtatcccgtttttgtttttttaatgacaggcagccccattttttcaaaaagaatgacgccaagctgcttcggcgaattgatgttgaattcagtgccggccatgctgtaaatccgctgctcaatttcatgaagccggagtttaaattcttcgcccatttcttttaaccggtcggtatcgactttcacgccggtgtattccatatccgccaaaataagggaaagtgggagctcgagttgttcaaacagttcaagctggccgttgtttttgagcgcttttgtgcaaggttcgcaaagggcatctatcgcttccgctttccgggaaatatgctcggcgtaccgtttttcctcgggcagcttccgtttcgcgccttttccgtagacagcctcatccgtttccacgttcccataatcatgcgtttttgccaccgaggcaaaatcttcgaccgtatcggaaggattcaagagataggaaacgagcagcaagtcaaagtcggtcccacgcaggtctatgccgtaccgtctcaaagcgacaattgaacgctttgcatcgtagacgtgtttgattttgctttcatcttccacccattttttgaacgcttcggaagaaagtgcgtcttccgcccggaggaaaaagagccctttttcgttttttaaaccgaacccgatgatctcgccagtatggtaattttcatcgagaatctccacataaaaagaagaaacatcggcaaacaagttgtccgtaatgtcttcggcaatggaaaaagaaatggcttccagtgccggtttttcttccgtcggggtgtccccgcccattttttcaagcattgatttaaagcccaattcctggtacaaatgccgtaatttttccgggtcggcgtgcttgtatgccgcctgttcaatggaaatggaaagcggaatgtcacggtgaatggtggcgagttctttgctcatcagcgcctgttctttgttcgcctccaatttttcctgcagttttttcccggatacttccccgatatggtcaagcagctcttccaccgtcgggaactgttttaacagcttaatggctgttttttccccgatgcccggcacgccgggaatgttatcggatgaatcgcccatcagccctttcatgtcgatgatctgatgcggcgttaacccgtatttttcctcgacatgcgccggcgtgtaggcttccatatcggtgatccctttacgcgtaatcattaccgttgttttcggcgaaacaagctgcgtcatatctttgtcgccggagatgactttcacaataaacccttcttcttccgcttttttcgacagggtgccgatgatgtcatccgcttcgtaattttccagttcgtaccgttcaatcccgtgggcatcgagcagttcccgaatcagcgggaactgttcggacagttccggcggagttttttggcgcgttcctttatattcgctgtatgtttcgtggcggaaggtcgttttgccggcatcaaacgccaccaaaatatgcgtcggcttttcctcttccaatattttggaaagcatcatcgtaaagccgtaaaccgcattcgtatgtatgcctttgtcattgttcaaaagcggcaaagcaaaaaacgccctataggcaatgctgtttccatcaattaaaatcaattttttcaaaaccaaaacctcccggaaaaatggagaatatccgttcatattcctttccccattttaccatgattcggcgcaaaggaaaaatcgcggcgcttttaaaaaaataaatgaaatattgccgctaaaaaaggcgcgatcatcaccttttccagcaatttttagaggatcagacgcgaaaaaaagccccaaacccttcatgcggatttggagcaggattttctgtttatgcgagggcatccatgactttccggacggaggcggcggatttgtcaagcgctgctttttcttccggtgtcagatcgagttcgatgattttttcaaggccgttgccgcccaaaatgaccggaatgccgagataaatgccgttgtagccgtattcgccttcgagataagcaacggcaggcaggatgcggcgctgatctttggcaatggcttccaccatttccgttaatgctgctgcgggcgcataataagcactgccgttaccaagcaggttcacgatttccccgccgccttttcttgtccgttccacaattttatcgaggcgctctttgggaagtaatgtttcgagcggaatgccgcctgcgtaagcgtaacggacgagcggcaccatctcatcgccatggccgccgagcacaaaaccggtaacgtctttgacggagacgtccagttcctctgcgacgaaagcgcggaatcttgccgtgtcgagcacacccgactggccgattacgcggtttttcggaaaaccggatgtttgataaaccgtgtaggtcattgcatcaaccgggttcgtcagtactatcagcacggcgtttggcgagtatttcacaatttcctttgtcacgttttccatgatcttttggtttgtctgcacaaggtcgtcccggctcatccccggtttgcgcgcaacgcccgccgtgatgacgacaacatcggaatcctttgtgtctgcataatcggacgtgccggtgatctttgcatcaaacccctgtaccggggatgcttcaaacatgtccaaggctttcccttttaccgggttttccatttgcgggatgtcaacgagcaccacatcccccagttctttttgggcaatcagaaacgccgttgtcgcccctgtaaaaccgccgccaatgaccgatatttttttccttttcagcatgacgagccccctttgtttaaatgtcagccggctgtaaaaaggcagccggcttgccgtaaatcatttgtccgttatttccccatgtttttaatcagttcatcgccaaattcagagcatttgacttctcttgcgccatccatcaggcgggcaaagtcgtatgtgaccactttggatgcgatcgttttttccatcgaaccgataatcaattttgccgcttcattccagcccaaatgttcaagcatcaaaacacccgacaaaataacggatgaagggttcactttatccaagccggcatatttcggtgccgttccgtgcgtcgcttcgaaaatggcatggccggtttcgtagttgatgttcgcgccaggggcaatcccgatgccgccgacttgtgcagcgagcgcatccgaaatgtagtcgccgtttaagttcatcgttgcgacgacgtcaaattcgcgcggacgggtcaaaatttgttgcaggaagatatcggcaatcgcatctttgataatgatcttgccgtttgcttctgcttctttctgcgcctggttggcagcatccgcgcctttttcttctttaatgcggtcgtattcggaccaggtgaagactttatcgccgaattccctttccgccagttcgtaaccccagtttttaaacgcgccttccgtaaatttcatgatattgcctttatgtaccagcgtaacggatttgcgcccttctttgatcgcatagttaatcgcagcgcgcaccagccgttccgttccttctttcgataccggtttgatgccgatgccggaagtttccgggaagcggatttttttcacgcccatttcatcttgcaaaaacgaaatgacttttttcacttccggtgaaccttcttgatattcaatgccggcataaatgtcttccgtgttttcgcggaaaatgaccatatcggtatcctgcgggcgtttaaccggggaagggacgccatcaaaataacggacagggcgcaggcagacgaataagtcgagttcctggcgcagcgcaacattcagcgaacggatcccgccgccgaccggagtggttaatggccctttaatggcaatgaaatattcgcggatcgtgtcaagcgtttcctgcggcagccattcccctgttttattgaacgctttttcccctgcatagacctctttccagacaattttcttttcgcctttataggccttctcaacagccgcatccaatacgcgctgtgcagccgcccaaatatcagggccggtgccgtccccttcgataaatggaataatcgggtgattcggtgtgtttaatacgccgttttctacggtgatcttttctccttgtgccatttcaaaatctcctccagtcccaatatcagtttatacttgtggtgtacacggaatgaaccggccccgcgcatggtcctgagccggtccttccccaccagatgcacgcttgcccatccccaaatacttccaggaacgggcgggcgttttaagaaaataacggataaattcagccgggatggttccccgccaaggtcccgttaccggtcttcaagcggaacgtactggcgcatgcccgggccaatatattccgcgcgtgggcggataatccggttgttggcgtattgttccaaaatatgggcgatccatccggaaatgcggctgacggcaaaaatcggcgtgaacaggtcatggtcaatgccgaggcaatgatagacagatgcagaataaaagtctacattggcaggaatgcctttttcgctcgtgacaatttgctcaatttttaccgacatatcataatatttacgctgcccggtcagctctgtcaatttttccgacatttttttcaggtgttttgcgcgcggatcgccttttctgtaaacgcggtggccaaaacccataattttttctttgttgatgaatttttcatgcaggtaatcttccactttatcgaccgaaccgatttccgtgagcattttcatgacctgctcatttgcgccgccgtggagcgggccttttaatgcgccgattgcagcggtaacgccggaatagatgtcggaaagcgtcgcaacacaaacgcgtgcagtaaaagtggatgcgttcagttcatggtccgcatgcagtacaagcgctttgttaaaggcttccacttcaatcggttccggttccttttcttttaacatgtacaggaagtttgcggcaaaaccgagatctctgcgcggtgcgacaggttctaggcctttcctgacccttgcgaaagcggcaacaattgccggtatttttgcctgcagccggatggctttgcgcaagtttgcttcccggtccattgcatcggcttcatcatcgtaaagcgcgagtgcggaaacagcggtacggagcgcggccatcgggtgcactttcccgatcgggtaagttttaaagctatccaaaatttctttcggcaattccatatgatccgccagttcctgcttaaatgtttccagttcggattttgtcggcagttttaaatgccacagcaggtagacgacttcttcaaagctggctttttctgctaaatcatcaatgccgtagccgacatatgtaagcgtgtcatcgatgatcgagctgattgaagtttcacttgcaacgaccccctctagacctcttgttgctgtcatgcttatctctccttctccttaaggttgtttcccccatctcaaacgtagataagttgatttcggggtatatatttttctgcggaataaataacggttgccggccggcaatatgcaagcgatcacatactctattataatataataattatatttgtctattttttgacgtacatgcgcccgcttacataaatcattataaacaattttcaaacacattggtacagaaaaaagccaaatttcttcttttagtatagcgctttcgcagccgtgctggcaatcattttgattttagcatatgcccttctgtagcagcaggagaaaaaccgttgaaaaatctttcttccaacggtttttacatgtttaagcaaattccacccggctaaaaactgtttgtcacccattcgacgattttcatggccatccaggcaatgccggcgccgatcagcggcccgaccgcaacccctttaaacaaagaaacggcgagaatggtgccaagcacgagcgccgtcgtaatttgcggatcgctcgcaagcagggtgataccgtttttggccagaagcgcgacaatgataccggatgcaagtgcaatccatgcatacggcgatttgagcgattcatacaaatctttaaagccgatctgtccggttgcaatcggcacaaggacggcgatcgtaataatggtgacgccccagttgatccctttcgactggacggttgaaaaaattttcgcatccagccctgccactttcaggacaagtagcacgataacagaaatgattaacgattggttttttgccgcaaatccgatcgctaaaagcagcaacaaaaataaatacggctggtacataagcatcccttctttcatgctgaaaatcttttggtgccgggtatttttttctgaatttttggtgaagatagaaatagaaaatctatcaaaaaaaacggctttttctttgttttacgccccccgccgtgtaaaataataacatattaacgaatacaggagggtcagacttgaattctgtttacatacaccgcgcgctgcggggcctttttgttgcactgtgcatcctggttggcttttttgcggtttatctggctgtaaaatacgcttatccgtttattattgcgctgttgatcgcgcttatgatcaacccgctcgtcaattttctggacagaaaggtaaggcttccgcgggcgcttgctgttttgatatccctgattctgatcattggcgtctttgtcggcatcattacgctgcttgttgccgagatcgtaacgggggcgaattaccttgctgacgttttgccggagcatgtccagacgcttgtcaattattcggaatcgcttgtcaccgcccaagttttaccgctgtacgaccagctggcgggcctctttaaaaatctcgatgcaggccagcaggaaacgatcgtgcaaaacattcaggcggccgggcaaaagatcgcttcttcagcaggtgatttcctgtccgggctgtttaaaaaactgccggggcttgtttcctggattccaaatgcggcaaccgtgctgatttttgccctgcttgcaacgtttttcatcagcaaggactggaaccagttgacaggcaaaggaaagctgttactgccgaaaaaagcaagaaaaagcgggatcaccgtgtttgccgacctccgcaatgcgcttttcggttttgtccgtgctgaattgacactgatttccatgacacttgtcattgtgctgatcgggcttttgattttacgcgtggattacgcgattacaatcgcccttgtttgcggcattgtcgatattttgccgtatttgggaacgggcgttgtgtttgtcccctggatcatttacgaattcattaccggcagcctgccgcttgcgatcgggcttaccgtcctttacattgtcgtgatcgtgcaaaggcagattatggagccgaaaattttatcgtccagcatcggaatgaatccactcgcgacgcttatcgccctgtttattggctttaaaacagtcgggttccttggcttgattctcgggccgattacactcgtgttgctgaccgcgctgatccgcgcccatgtattccatgacatttggaactatattatgggcaaaaaaacaatataaaaaacgcagaggccggatgcctctgcgtttttttttgcttatttacaatacagtcgcatggccgttgtaaaccgagccggttgctgcatctaccgtaacttcctgcccgtctttaaaaatggaaacggctttttcaacaccgacaatgaccggaatgccgacattgatgccaacaactgcagcatggcttgtcaagccgccttcttccgtaatcagcgcggcacatttttcaatggccggcatgatttctttgtcggtcgttctcgtgatgagcacacagccttctgttgcttttgcgtttgcttcttctgggctttcagcaacaacgaccggaccaaatgccgattttctgccgattccctggccttttgccaatatatcgccgatcaggtgcactttcatcaggttggttgtgcctttcccaccaacagggacgccggctgtgataatcacaaggtcgccgtgatggacgatatcggatttcaatgcttcatccactgcgatttcaagcatttcatccgtattgtttgcctttgtgcccaattgcgggtatacgccggacacaacggttaagccgcgctgcactttcggatcgctcgtgacagcaataatcggggctgccgggcggtatttggagatcatgcgcgccgtatagccgctttcggttggcgcaataatggcattcacatcaagatttaaagccgtatgggcaacggactggcaaatggcgtctgtcatattatggtccgtgctcttgctgcgtttgttcagaatatcgcggtggttaatcgctttttccacatggaccgcgatattgtacatcgtcttaaccgcttcagcaggatattttccggctgctgtttcgccggaaagcatgattgcatccgtgccgtcgaaaatggcgttggccacgtcgcttgcttctgcgcgggtcgggcgcgggttgcgctgcatcgaatccagcatttgcgttgcggtaatgaccggtttgccgagcgtattgcattttctgatcagctctttttgcacgagcggtaccgcttcggtcggaatttcaacgccgaggtcaccgcgggcaaccattaagccgtccgatacagctaggatttcatcgatgttgtcgacgccttcctggttttcaattttagggaaaattttcacatgtaaagcatcgtgttcttcaaggagctggcgaatttccaaaacgtcagacggccggcgtacaaatgaagccgcaatgaagtcaatgccttgttcaagcccgaacaggatatcgctcacgtctttttcggtaatgcccggaaggttcacggagacacccgggacgttgacaccctttttgtttttcaaaacgccgcggttcagcacttttgtatggatttcaccggcgtttttatcgatggccgtcacttccagttcaatcaaaccatcatcaagcagaattttagagccaacgtgcacatcatcaatcagcccttcatacgtgaccgaaaatttttccgttgtcccgagcacttctgtcattgaaatgaccggcgtcatgccttcaacgagctcaaatccgccatctttcatatcgtgggtgcggatttccgggccctttgtatcaagcagaagcccgatcgttttgttttggttttttgcagcttcgcggatatttttaatccgggcaagatgttcctcgtggctgccgtgcgagaagttcaggcggcaaacatccatcccgtttgccattaatctttcaagcatttcaacactttcactggcaggcccgattgtacatacaattttggtttttttcattctatttcctcctaaacaacgttagatcgacaattctttcgacagcttatacatgttttgattaatggcgtgcggtttcccgagaatctcaaggatgtcatggtcaaccagctggttattttgaatgccgacagcgcggcccccttttccttcgagcagcagttcaacagcccttgcgcctagtcggcttgcaagtacgcggtcaaatgcagtcggagaaccgccgcgctggatatggccgagaacggaaacgcgggtatcaccgatcacgccggtttttttcaatttttccgcaaactcgttgccactcatcacgccttccgcgacgatgataatgctgtggcgtttgccgcgttgtttcccttgttcaaggcgctccacgacatctttcaaatcaaatttttcttccggtacaataatcgattcagccccgccggcaagaccggaccaaagcgcgatatccccggcatttctgcccatgacttcaataataaaggtccgttcgtgggaagaagcggtatcgcgaattttgtcaatcgcatccagaacagtgttcagcgctgtatcaaaaccaattgtaaaatccgtacctgggatgtcgttgtcgattgtccccggcacaccgatgcagttgaaaccttgttctgtcagttttttcgctccctgataggaaccgtccccgccgatcacaacgagggcttcaatgccatggtctttcagctgccggatcgctttttgctgcccttccggtgttttgaattcttcgcttcttgccgactgcaaaaccgtgccgccgcgttggagaatatcgccgacagatcccgcttcaagcttttggatgttaccttgaatcaacccgttatagccctggtgaatgccgtaaacttccaggccgtggtaaatccctttacgggtaatcgcgcggactgcggcattcatccctggtgcatcgccgccgcttgttaatactccaattcgcttcatatgattcacctctgtatatgtaattctcttggcaggccggtatttcaatcaagcaaagtaattatagtatcgccaagtctgccttcgaatatatctaaaataccactttaaaagcatgttcacaatcgatcatgaaaaagtaaaaattttaaaaatgtgcgtttatgaacaaactgtgtcggaatagtatgaatacgttaccaattctcctgtcttccctgcctgccatgcaaacggcgttcttttttcttttcccggtttccatgccggtaaaccaggatctgaattttcttttcaaccacttagaagaaaggggatcctatataaattgaactaaacattactacttgtttatgtgctgccatcccgatcgtcattgattttggtacgaaaaacttaagttcattttatatagctggaaagcagaacgccaaaattttggcctgcatccgttacaccatgtaaaaagcgaggcaaccggtgatggatgccggttgcctgggtgcttttttcggctattggcgggcaaactgttcgagcgttgaaaatacgccaattttacggtatttttcgtaccttttttccaccagttcttcaggggcatatgcccgcagctcctttaatgatgcggcaagcacagggcgcatcagctctgcctgcgctctcggatctttatgtgcgccgccttttacttccggaatcagttcatcgataatacccagttctttcagctcgggcgcggtcatcttcatggtggcgacggcccgttttgcctgcgacgcatctttccataaaagcgccgcggcggattccggtgaaatgaccgagaaccatgaattttcgaggacatggatatggtcgccgacgccaatgccaagcgcaccgccgctggccccttcgccgataatcaggcagatgatcggaacggacagcccggacatttcaaacaaattgcgcgcgatcgattcagcgatgcccctttcttccgctgcttttcccggatacgcaccttttgtgtcgatgaagctgataatcgggcgtttaaatttttccgcctgcttcattagccgcattgctttccggtagccttccgggtgtggcatgccgaaattgcggcggatgttttcttttgtgtctttcccccgctgctggccgatcacggtgacaggaaggccctcaaattttgcgatcccgccgacaaccgccccgtcgtcgccgtatacacggtcgccgtggagctcaagaaaatcggtaaaaagatattgaatatagtccaatgatgtcggccgttcgggaaaacgcgcaatctggattctgtcccacggatccatattttcgtaaatttcctcttccagccgggaaagccttgcttccagtttttcaatctcgcttgacaaatcgacatccgactgttttgtaaattcctttagctcggcaattttgcgtttcagctcaatgaccggtttttcaaattcaagttcattcaccattgtagttcacctgcgtttgttggttgatggatgtccagaatgcctgccaatgtttttttcaggtcatggcgtttcacaaccgcatcgagctggccgtgttcaagaagaaattctgcagtctggaaaacttcaggaagttcttcgcggatcgtctgttcaatgatgcggcggccggcaaaaccgatcaacgcgccgggctccgcaagattgatatccccgagcgatgcaaagcttgcggtcacgccgcctgttgtcggatgagtcatcacggttaccgttaacccgccgtggcggctgaacctttcgagcgccgcgctcgttttcgccatctgcattaaagaatagatcccttcctgcatgcgggcgccccctgaggccgtgaaaatgataaacggcacatggagcctgtctgcttcttcgatggcgcgcgtaattttttcgccgacaaccgagcccatgctgcccatccggaattgtgcatccatgacactaagcacgaccggcctttcctgaatgttgcccttacctgtcagtaccgcttcattcaagtttgtttttttgcggtctttttccagtttttcaaggtaacccggaaacgcaagcgggtttttggaaacaagcccgcggtcgaactcttcaaacgttccttcatccagcaggctttccaccctttcataagcggtcatttgataatggtagccgcaatggaggcagacttttaaattcttctgcagttcttttgtatacataattttgccgcacttcgggcattttgacatgatcccttcaggaacttcctgctttgtatggtctgaagggatagtcgcatattttcgctttttcggtttagaaaaaaaatctttcagcaaatcttacccctcctgtatctggcaccggaaccaccgggcaagccggcggtttttctgccgaagtaccggcaaatggcgttttcccgtaccggcaaaaaggcggctttttttccggcatctgatgcttatttgccaatttcggaaagctgtttcgttttttcgcggatttcttccgggctcacctggatgcgggcgacaccggtttccatcgccgcttttgcaacagctgccgcaaccgccggcgcaacacgcggatcaaacgggcgcggaatgacataatccgcattcagttcatgttcatcaattaaaccggcgatcgcgtggacagcggcttgtttcatcttttcattaatatgcgtggcgcgcacatccaatgcccccctgaaaatacccgggaaggcgaggacattgttgacctggtttggaaaatcagagcggcctgtgccgatgactttcgcgccggccgctttggcatcttgcggcatgatttccggattcggattggccatcgcaaaaataatcgggtcttttttcatcgactgcaccatttctttcgtcagtgccccctctacagaaacgccgataaaaacatccgcatctttgatcacatccgccaggctacctgctgctttatcacggtttgtatatttggccacttcgaatttcaccttgttcattccaaacgggcgcccttcatagatcgcccctttagagtcgcacataataatatcgcggacgccaaagttgtaaagcagtttgataatcgcgatgccggcagcgcccgcgccgcttgccaccactttaatttcagacatttctttgccaacgagttttaaagcgttcacgagcccggcagccgttacaatcgccgtcccgtgctggtcatcgtgaaaaacaggaatattcatttccttcttcaatttttcttcaatgacaaagcagttcggcgcggcgatatcctccagattcacgccgccaaaaaccggttccagccgtttcactgtctccacgatttcatcaatatctgtcgtatcgaggcaaatgggaaaggcatcgacgccggcaaagcttttgaacaaaatcgccttgccttccatgaccgggagtgcggcttcagggccgatatttccaagcccgagaacggcggtgccgtccgttacaaccgcgaccatattgcctttcatcgtatattcatagaccgtttccggtttgtcgtagatcattttgcaaggctcagccacaccgggcgaataggccaggctcagatcctttgcatttttgacggtgacttttgacttggattccaatttccctttgtgttcgcggtgcatatgtaacgcttcttcccgcaatgacatgaacctcactcccccgttttcactgcacgatatgcggtttcttactcacaagcctattaaacaatataacatatttaatctagagagaaaaacttatttcaatatgacatttccttcaccaagcagttccgtaagctttccgaggcatgcttcctccgcccggacccggtttttttccggaagccggatcgttttccgttccgcttcataatgaagaatgaccggcgagtcccccggaaaagcgtcaagcacctgcttcacttgaacaagcagcatgcggtcctttccagccggaatctttaaatataacgtggcaccggtcggcatgctgcggaacgggctggcatcttcgagcgcccgggcaatcacctgctttttgccgttcctgttttcaacatttccttccacgaccacaatcaaccctttttggcataacgggctgtattttttaaagacatccggaaaaacaacacattctatctcatccgtttcgtcactcatgcgcaaaaatgccatcaggctgccttgttttgtgcggatcgttcttgtgtccgtaatgcaggcgccaaaccggatttttctcatgccgggttgaagcttgcttactgcaagcacgccggcttcgtcccaacccgggcggtactgcccggccggatgcccggatagatagagccccaaatattgcttttcaaaggcaagcttatccatcagtgaaatcggctcggtttccacataatttggttcaatgctgaacgcttcatcctcaaagaacagatccgcctgcccgtcatccggcttcataatctccgcgtgctcaagggcgacatcaatgctggcaagcaaaactgccctgtcttttccaaactcatccatcgcgcctgagaatgcaaacgcctctaaaattttccggttcagccctttcacccgcaggacaagatcaaacaggcttttaaacgggcgccgttttctttctttaagcagctctttgatggaggcgtatccgatcccttttatcgcggcaaggctataacggatggcgccgttttccacggtaaacggataatggctgtgctgcacggaaggcggcaaaacccggatccccatctgctgcgcttcgcgaatatactgggcaattttatcctcgttgccgatcacgctcgtcaaaaggcttgccataaaatagagcgggtaatgggcttttaaataggcgagccggcaagcgagcatgctgtaagcgacggcatggctgcggttaaaaccataattggcgaagcggacgataaaatcataaatagtattcgccgtttttctctcatatccttttttttgcgcgccatttataaaatgcagccgctgttcgtccaggatttcccttttctttttgctgacggcacggcggagcaaatccgcctccccgagtgaaaagcccgccatctttgaagcgatctgcataatttgttcctggtagacaatcacaccgtatgttttttccaaaatcggctggaggtcgggatgcggatattcgaccggtttcaacccgtgtttccgctcaatataggccgggatgttttccatcggcccgggccggtacagcgcattgaccgcgacaatgtcttcaaattcagtcggtttaagccgctcgagcactttccgcatgccgtccgactcgaactggaagatcccggtcgtattgcccgaactaaaaaggcggaatgtctgtggatcatcgagcggtacatcctggaggcggatttttctccccgtccccttttcaatccccgtgaggatatgctcaaggatggttaaattccgcaagccgagaaaatccattttcaaaagcccgatttcttcgagatggttcatcggatactgggttaaaaagatgccgtcatgcccttcctgcaccgggatgattcccgtaagcggttccccactgataatgacgccggctgcatgggtcgaaacatggcgcggcaatccttccaaaagcagggccgtttcaaaaagcttgcggtgctgatccgattggccgatccattcccgaaaggcgcttgatgcttcatacgcttttttaagcgtcatgccaggctgtgacgggatgaagcgcgacaactgttcaagttcttttgcgctgagaccgaatatccgggctacatcccgggctgcggctttcgcagcaaatgtgccgaatgtgatgatctgcgcgacatgctgtctgccgtatttttccgcaacgtagcgaatcatctcgtcccgcttgtgatccggaaaatcgctgtcaatatccggcatggaaatgcgctccggatttaaaaaccgttcaaacaaaagcccgtattgcaccggatcgacgtcggtaatataaagcgcgtatgcgacaagggagccggcagcggaaccgcgccccggcccggtaagaatcccgtgctccctcgcatatttcataaaatcccagacaataaggaaatagtcgctgaactgcatttcctgaatgatttttaattcatactccagccggtctgtataccgttcttccagattcggaacgcgtgctgcaaggccttttcggcatacttcttctaagaaggcatccgccgtctgcccgcccggaaccggaaatgccggcagcagccgctgtcccgttttgatttccacagagcaggcatctgcaattttttccgtattggccaaagcttccgggaaatcggcaaaaagctgttccatttcctcttgcggcttaaagtcgtgcgtgccgctttccgggcgcggccggttttcatccgtcagtttcaccccggctttgatcgcgcgcaacacttcatgagaaaaagcatcttccttttttaagtatttcacatttgcggccgccacttctgggatacccagtttttccgagagcgcgtgcatatcgggaagcactttcttagcttgcactgtcccgttgttttcaagtgcaagataaaagctcggcccgaaaatgtcccggtataaaactgcaacctcttctgcacgcgcttcatctcccctaagtagcgcctgttcgatttccccttcaagccccggcgtaaaggcgatcaggccgtcgctgtaggcgcgcagccatttgataaaaatgccgggttcgggtctcgtctggatggcacttgagattttcatcaaatgccggtagccggtttcgtttttggcaagcaacacaaccggataggctgtgtcaggttcaaacgaactcatgatatccgctgtcatgccgataatgggtttaatgccattttcgcggcaagccttgtaaaaaggaaaggccccgtacatcacattgcggtccgtgatcgcaagggtgtcgtaatgaagcgcttttgcgtacgccgcccattcagggatggagatcgtactttccaacaggctgtaggccgtttggacctgtaaatggacaaaacgcatggtaaactgcctcctattcgtacctgtacatgattcttattatacatgttttcacgcgagcaaaaaagaagatacgttcgatttcatacaggcatacattgtcccatatattgtttagtaatgaagaaaagatggggatggttcggttgagcgaaggattttttcccgcatttttcaacagctattttatcgcattcggcgtaatgttcggcggcgccttgatcgggggactcgcttcgttcattaccggcgagccgcttttgacggaaatttcgaagattgcgcgtgacctccgcatctgggcgatcattgccgccatcggggggacgttcgataccgtttacagctttgaaaaaggatttttggaaagcgagacgatggtattgttcaagcagctgcttttaattctgtcggccatgggcggtgccaaaacggccgcgctcattatttcatggataacccaggagaatgtgctatgagaatcccgccgctttaccggaaaccgggctggcagcggttcatggccggatttatcgtgggcgggtgcatctgctggctgatttttctgtacatgttcggtgtcatgcaggaaaggcaggcgcaaatgattgaacgacaggaaaaaacgatccaggatttgcaacaggaaaaggcgatctggcaggaagactataaaaagctcaatcaaaaaaatgaaaagctcctgaccatccagcgtattgacgtgaaaatcagcaactacgaaaaatatgacattcacgattcacaaagcatttttgaagcagaagaggatattaaacatgacttaagcccgctgattgcaaaaaatttaaaaaccgcttatttgaacaaagacttgatcacccgcatgcttgaaaacaaagtcattaaaatcaaccaccgccgctatactttcgaagtgcgggacattttgttttactccgttgtccgcgtccacctgaatttaaagctggcagactaaaagaaggcaaatccgcttttccggcggttctgccttctttttttacccttccttgcagagcgcgattaattccttttttaccgcctctgccgtttcccacgaatacgcggtggccccggccgcaagcggatgcccgccgccgccgtatttgcgggccagctcattgatggcagggcctttggagcggaaacggaggcggatttggccttcttcttcgataaagaagcaccaggctttaagccctttaatatcgccgagcgtggtgacaagctgggaggcttcgcgcaccgttacgccgaatttttcaatcagttcttttttcagcacgacgatggccgccccgtgctcaagaatgtccaggttctggtagatatacccttgcagcctggccacacttggttcaatctcgtacatcttgttaaagagcgctgtccggtcaaaatggtaatggatcagttctccggcatagtcaaatgttttttccgtcgcactcggatacaaaaaccggcccgtatccccgacaatgccggcaaacagcagccttgccgcaacatctgtcatcctgagcccttcttctttccccgataagtaaaactcataaatcatttcgctgacagaggacgcatcttcatcgacccactgcaaatccccgtaagcatcatgattcgggtgatggtcgattttgatcagcctttcccccagatggaaacgctggtcgctgatccgctcgcggttcgcggtatcacaaacaatgacaagcgccccgcgatacgtttcatcggaaatcctgtccatcctattcaagtaggcgaggtccggttcatcatcgcccacgatataaatgtttttacccggaaaagacgccttcaatatttccgcaagtcccccctgcgatccatatgcatccggatcaggccggacatggcggtggatgatgatcgtgtcaaaaagcttgatcgtctgtaaaatttttgttttcatcttactccccgtttctctggcaagttcttttttcattttgtaaaatagaagaaaatacggacaacccgatttggaggtgcacgatgccgatccttgccgttttgattctcgcatccctttgcgcgtatgtatattttaaactaaaatacatccgcagcctgttggagatggaaaaaaaggtgttttccgccaaagccaatatggcactcggttcgtttatttttttgttcggcgtgaatgaattgtttctgtttcacactgccgtcacctatgccatcgcagccatttttatcgcgctcgggctgttcaatatcgcaggtggtttcaaaagactgcagttttaccggcccgaaatgcagaaagaaagaaacgaatcgcggcgcacactgtaaaaaggagtgggcacgtaccgttatctttcaatcagttggcacatcagcagggctttaccgacaaggctgccttggttgaagacttcgacatcaattttggcaaatttccggccggaatcgagaattttcggtacaatccggatcatgctttcgagctggaccggtttgataaaatagaccgttaagctttcgatgatcatttcgcctttttttctggagcgcaaaaagcggttggtcgtttcgtgtacgagtgtcgtgaatacaccatatgaaatcgtccctaaagggttggtcatttgcggcgtcacttcaaactggtaatcatccgggtcttccgttttggccgatgatgcatcaagctgggtcgtgacgatattgtcgatcgtttccccgacttgcggctggcgctgtgtcatttgcagctcctttaagacgtcctggcggctgacaatccccctcagccggttaaaatcgtcggtcaccggcaagatttcgatcccttcccagaccatcatatgggcaacagatgtaacgcttgttttttcgctgaccgtaatcggatttttcgtcatcactttctcgatgcttaagtgcgtgtcggtttccatcacgtcttttgaggtaataatacccgccacctttaaattgcggtcgacaacaggaaagcgcgagtggcctgtttcccgttttttgcggtaccagtcctgaaccgtgtccgttgtattcaaataagccgttttttcaatcggtgttaaaatatcttcaacgagaataatttcttttttgatcagctggtcatagacagcacgattaatcatcgtcgcaacggtaaacgtgtcgtagctcgtcgagatgatcggcagcgatttttcatccgcaattttttttacataatctttcgtatcaaatccgccggtgatcaaaacggcagctcctgaccttaacgccagttcatgcgcgtccgtgcggtttccgacaatgagcaggctccccggatccgtatacttcgacatcgcctcaagctccatggcgccgattacgaattttgtaagcgttttatgcaagccggattttccgcccagcacctggccgtcgataatattgacgacttccgaaaaggtcagcttttcaatgttctcttttttcttctgctcaatccggatagtgccgacccgttcaatcgtgctgacatacccttttatttcagcatctttaatggcgcggtaggcggtcccttcactgacattcagcgcttttgcaatctggcggacggatattttttccccgaccggcagctcattgatatattgtaaaatctgttcgtgctttgtcgccattttttcaccttctttccgtttttatccgctttcaaggaatatgtatggagtcatctgtataattctattatagatggaaaaagggggaaagggcaatcaggcacctttatctttccatcatggaaaaggggaagtgcggccggcactttttcagcacatgccggctgcaagcgaacccctgtatttgccaatcttgcgcgtctattacaattcgatcgcatctccggctttcataattttaccgtttacgccgtcgagcaaatcgataaatttctgcggatcctgctgaatgagcgggaacgtattgtaatggatcggcacgaccgttttcgcctgcaaaaatgttgccgccactgctgcgtcttccggtcccatcgtgaagttgtcgccgatcggaagaaatgcaagatcaatcggatggcgttcgccgattaatttcatatccgagaacagcccggtatcaccggcgtggtagatcgttttcccttccgccatcagcaaaacgcccgtcggcatcccgagataaacgatttctttcttttcgtcatccacaaccgccgagccgtggaacgcctgggtaagcttcactttcccgaaatcaaactggtacgagccaccgatatggagcggatgcgtattcaaccctttccaggcaaagtaatttgcgatttcattattggcaataataagcgcattctttttgcgggcaagcgtttctgtatccccgatatgatcgccgtgcccatgtgtgagaataatcacatccgggctttcttcctccactttcaggtctgtctggctgttgccggtaataaatggatcaaagagtatcgttttgccctccgtttccacttttacaatcgaatggccgtgaaaagaaactttcatcaacatatcactccttttaaaaatttgtacggcttttaggggccactttcattatattatttctttgccccgtaatcctgcctcgcgcttcacctgtagcatcttaacttgttttttgctatgctagtaacgtctgataaggagatgaatggaatgaataagcgtttagcaagtgtggcggcgtggctgaaagcggaaaagaccgatgctgcttttattacatcgcccgacaatgtcttttatttgagcggttaccgcagcgacccgcacgaaaggctgctcggcatttgtgtattccaagaaaaagagccgtttctcgtctgcccggcaatggaggcatatgacgcgaaaaaagctggctgggaatatgacattctcggcgtccaggatacggataacccgtgggatttggttgcggaagaaatacgcgggcgaatcggggatgtccatacgttagcgattgaaaaagagcatttgaacgtggaacggttcgaagcgctgaaagaacggtttggcggcgcccgctttaccgctgctgaagaaaaactgcgcatgatgcgccttattaaagatgagcatgaacggaagattttaagggaagcggctgcttttgccgacctggccgttgaaacgggcatccgcgaaattaaggaagggaaaaccgaacttgaaatcgtggcagccattgaatttgcaatgaaagaaaaagggatttcagaaatgagcttcgccaccaccgtcctctcaggtgcgaaggcggcttccccgcacggcgtccccggccttgacaagatcgaaaaagggaattttgtcctgtttgaccttggcgttgtgcatcaaggctactgttccgatattacaaggacggtcgcattcggggggcttaacgaagagcaaacccggatttacgaaacggtattaaaagcggaagaagcggccgttgcggcagcaaaaccgggggtaaaggcaaaagagctcgacttgattgcacgccgcatcattgaagacgcgggatacggcgaatattttacacaccggctcggccacggcctcgggatcagcatccacgaatatccttctgtcacccatacgaatgagctggtgcttgaagaagggatggtcttcacgatcgaaccggggatatacgtgccaggggttgccggcgtccggattgaagatgacgtctgcattacaaaaacgggtgccgaagtgctgacaaagtacccgaaagccttgcagtatgtttaaaaaagaagcacaagcggctttcatgctgcttgtgcttctttttttgttccggcaattcttgcagccggcttttgaaagcttattttaaaagcgttttcacatcggtataggagagcccgatcgaatcggccaccgctttatacgtcacatgcccgttcagcgtattgaccccttttaacagcgcttcattttccaaaaccgctttctcataccccttattggcaatttgcaccgcgtacggcaccgtcacattggtaagggcaatcgtcgatgtgcgggcaaccgcgcccggaatatttgcgactgcataatggacgacatcatgcttgatataaaccggatcatcatgtgtcgtggcacggtctgtcgtttcaaaactgccaccctggtcaatcgcaatatccacgacaacagagcccggctgcatcgctttgatcatctcttccgttaccagttttggcgcttttgcacccgggatcagaacggatccgatgacaaggtccgcatcacgcactgcttccgcaatattgtatggattcgacatcaaggttgtaattttgctgccgaaaatgtcatcaagctggcgcaagcgatccggattcaattcgacaacggtcacatccgccccaaggccgatcgcgacttttgccgcattcgttccggcaaccccgccgccgataatcgtaatcttgcctcttttgacgcccggtacgccggaaagcaggatcccttttccaccgttatttttttcaagaaactgtgcgccaatctgcggcgccattctgcccgccacctcgctcatcggcgtcagaagcggcagcgaacggttggcaagctgcacggtttcataagcaatgccggtcactttctttttcagcagttcttccgtaagctttggtgctgcagcaagatgcaaatatgtaaataaaatcatgccttcacggaaatagcggtactcgctttcgatcggctccttcactttcataaccatttcaaaagaccacgcctcacgagcggtctcaacgatccgggcaccggcttttacatattcttcatcactaaaccccgatgcaaggcccgcattcttttcaataaaaacttcatgccccgctttggtcagggtcacaacgccggccggggtcatggccacacggctttcattgtttttaatttcttttggtacgccaattcgcatagaaagttcctcctcttgttcgtgttttgcaatccgttttcttattattgtaagaaaacatatcaaacggttgaaaactttcttaaacatctttagtgtagcaaaaattccctctttttcctatgctttttttgcaaatttcttattcgcgcccgggaacgggatagcgtttttatttttcctggcttccgccctttttgattaaaaaatagatcgccaggttttttcatttttcgcacacaaacccggaaaattctagtaaaatagacatgaaaggcaggcagtttataaaggagatgaaagaagatgggcacacaataccggaatattttagtagcggtagatggctccaaagaagccgactgggcttttacgaaagcggttgaaatcgccaaacggaatggggccgaattatcggttgtccatgtggtcgataaccgagcactcgccactttgaccccgattgattcaacgctctatgagcaaaacgaaaaatttggggatgaactgttaagcaattataaagaccgcgccgcagaaaaagggatcaaagtccagacgatcatccagctcggctctccaaaacttcaaatcacaaaaaatgtcgcgccgaaagtgcatgcggatttaattgtgtgcggcgcaaccggtttaaacgcggtggaaaggctcctgatcggaagcgtttccgaacatattgtccgcacttccccctgcgatgtgcttgtcgtgagaacgcctaaggaagaagaaggcaaaggggaaaattaagcaaaaaccagccttttacgggctggttttttaacggccgcttttttctgttaaaaaccggtattgataatatttctccgcaatttcacaaacccttttagaaaaatagtagtttgtaagagccccgatggccatcccggcccagctgttttctccccgctttttcggccggagcagcgccagaaaagcgagtttgccggcatgcccgattgcccccggccacaaataccggtggaataacttatcgtttcccacatagaagccggtctcgcgcgcttccagttcatccatcaattcttcccagagcgcatatttcaccatgtccggggcagcggccatcagcaccattttcagcgccgccacgagttcgccgggcgtttttgtttcaaatccgtaagctgcaccggtgagctggaccgcccggagattcacagccagcaggaaaaacggatccgccgcggcaaaaacagctttccccgtcccgctcaatgctccttcgaagagtgagaaacggcggtattttgcctgctgccgcgccgcaataaaccctgcctggtcgatggtaagcttcctcatatcgggaatcgttgcaacagaactgtcaaaaagccgccccgcagcaagtattttttcgatttcatgcccgtaaggcagattttcatcggcaaatgaacagatttgaaacaaaacagcatctattttttcatgaatattttcgagcgcctcatccggaaaatgggcaaagagcgcatccagtttttgcttgcgcccgtccccttcttttccggccgtttttagcttctccgcccagtcgttgatttcatccaggactattttttccctgtctgtccattccgccattttcgatccgctcccaaactctgttttacagccattataacataaattccatgcacggctgtccgtttatgctatgccaaagcgcttcctgaaacgatttattcgggcacgggcagcagagaaagcaagctgccggcgccggccggcttccgcggtcatgaagacagccggacaacatcgcgtgcgatcatcagctcttcattagtagggataacgagcacttttacaggggaatgcggataattgataaacgcttcggtcccgcggatctggttcagggtcggatcccagtaaatgcccataaattccagtcccgttaaaattcttgcgcggatggcatcgctgttttccccgatgccggctgtaaaaataatcgcatccacgccggccattttcgccgcatacgacccaatgtatttatggatgcggcttgcaaaaatgtcaagcgccagttcagcccgcttattccgctcgagttctgccgccacctggatatcgcgcaaatcgctggaaacgcccgaaatgccaagaagcccggattctttgtttaacacttcgagcacttcttccgcggttttgcctgtcttctccataataaacggaatcagcgcaggatcgatattgccggaacgcgtgcccatcgtcacaccggccaatggcgtaaagcccatggacgtatcgattgaccggccgccctggatcgccgcaatgcttgccccgttgcccaaatggcatgaaatcaggcgcaactgttcaatcggcctgccgagcagctcagcggcgcgcatcgctacatatttatgggaagtgccgtgaaacccgtatttgcggatccgatatttttcgtagtattcatagggtaggctgtataggaaagcactttccggcatcgtttggtggaaagcggtatcaaacacggccacttgaaccacatccggcagcacggcacggaacgcccggatccccgttgcgttcgcccggttatgaagcggcgcgagttccgccaaatcttcaatttgcgcgagcacctggtcattgacgacagcagaatcattgaatatttcgccgccgtgcacaacccggtggcccacgccttctatttcatccaaagaccggataataccggtttccgttaatttatttaataaaaactgcacggcaacttcatggttcggaatatcggtaatttccttcaccctgtccccgtttaccgtaatggaaaacaaggcatcgtttaacccgatccgttcaatcaggcctttcgttataacgctttcattcggcatatcaaataattgaaattttaaggaggagctccccgcattaattgccataatttttgccattgctcgtcttcccttcgcaaaatcaaatgaacccttttatttttttaaaatagtgatctcattttctcattttgccattctatccggtttttttcaaccggtttttggtttcgtctcccgggaacatataaaatgataccataaaaacacaaacaaatgggggccggaacgcaatttcctgctttccggcccccatttttcccaattcgtcaaattttgccgctttggatattttctttgcaccaggcgtccatttttgccatcagctgccttagcgccccctcgttggacagggacgggagcgacgccagcagcacttgttccggcgccttcacgccttccgctttcttgcggatgacaaaaatgcttttggcagcctgttcgtttttgaagatggtcatcggcaattgcaaaatcgcctggatatccgcctcttcttttaaaaaccggcgaagtttcggggcttcttttgtttcaaataatccgtttgggatgagaaaaaataaaaatccgcccgggcgcgccgctctcaggctctgctcgataaacaaatgatgggcgtacgaatgcccttcatctgccttcagcttgtaatctgcggcgcccgcatcattcgggtagtatccgaccggcaaatcgcaaacaacgatatcgacagggtcaatgaacaattgggacagggcatcctgcgtaaacagttcgatttcatggtgcagaaggttcgcccccgtgtatgcgagccggatcaaaacatcatcgatatccacgccataagcagtgatgtttttcccgctgagctggttcaaaatggtcacaagcaaattgccggtgcccaccgcagggtccaaaatcgaaaacgcactggtatcttctgcaaacttgccgataaaatagctcatcagcagtccgatcgaatccggcgtcatttggtggtttgcctggacgtttgctttcatccccttcaggatggcgagctggtaggctttccggatttgctcgcgggtaaagtccccgaggcggaccgttccgtataggttttcaaggcgtttttcatcgcgcgcatcaatcccattttggcggatgcttccggtgaataaattttccccggtcatcgccacggcttccaaatacgggacagagaggcgattttccaagatttgcgcggattcgttaaaaacggtaaaaagggtttcaacaggagaggccgacattcattctcctccttcatattcttcttccatataaaatccccgatggagatcggggattttatcgcagtatagcaagcgctcttcgcgtttcccggcgctattcaatgcctgttttacgatgcatcttttgcggcttgcaaggctttttcgtagtcaggatggttggtgccttcgcttacatattccacatatgtaaccgtatcattggaatccacgacaaatacggcgcgggcaagcaggcgaagttctttcatcacaaccccgtaagctttgccgaatgacaggtcgcggtggtcggacaacacttttacatggtcgagcccggatgccccacaccatcttttttgagcaaaaggcaggtcacaggagaaagtataaacgttgacttctttcccgagttttgctgcttcttcgttaaaacggcgcgtctgtgcatcgcaaacaccggtatcaatcgacgggacaacgctgaagatgcggacgccgccttttgtatccgaaagtgtcacctcattcaagtcattatccagaaccgtaaagtccggtgccttatcgccaacttttacttgtgtcccttccaatgtgactggattccctttaaatgtaaccgaagccatgaaataccctccttatttttgccggggcttacaatccccgtatttcagctgtgctcataccttatcatactggacaacgaaaaaaatttccaatttaaaacccgcgaatcatgcgggttgttaaaaatcaagatcctgtttttgctggttggccggctgttgcccgccattttggccgccagcattttggccgttttgtttcagcatgctctggattttttcgacaacgcccggtgcgacatccataattttttcaatcagatgcgtgttttggtccagatgcagcattttcacgccttgtgcgccaacaaccaaaaaggcaatgggcataatcgagacgccgccgccgctgccgcccccgaaaggcagctctgccgggcgggattcgccgctgccgccggatccggatggcccgttaaattggctgccgcctgccgcaaacccgaaaccgactttggatacggttaaaatgacgcttccatccggcgtttccaccggatccccgataatcgtatttacgtcaatcatttcttttaaattttccattgcggccgtcatcaggccttcaatcggatgtgaacccattgttgtttcctcctgtcatttgtttctgccgggatttaagcatgccggccgttttccggctcagaaaccggtgtaagcgcgatttccgcttttcctccccgccagtatttcagcattttaaatgcggctattatagctttcccgatctggattttcaccatacattttaactgtgtttcggaaatcgggtactggaaaaagggcgtaacggaaaggacaggatccgtttttacacgcagatgtgtggtaatgaggcttaagatcccccctttcaccgcccagatgcttccggcgacaattcccgtccacgcggcatcatgcagcccgattgctgtatgccattcgaattttcttaactggacattgcggatgaacttgcctgcaatcgcctttaaaccgatgacgcgctccgcaatttttttcacatcttcaatccgctgttcgaggacatccggcgtaatgttcctttcctgctctgcatgttttgtctctttttcatatacgacaccgggttttttccggtccactttcactgccgggattttcacggtatagcggatgatgccccacaccctgatttggataaaaattttatcatcatctaagcggtgcccgtattcaataaggacggacagggaagagaaccatacaatcgcagtgattgcggcaagtgcgaaaaacgcggatagccaccatatcatttccatcatcagccttttttgcaaccattatcgccaacagggcaaaaaaataaacctgcccttaagcaggttcataataaggatagaccggttcatgggaccgttcatgaatgacggccgtatcggcaaacaaatcgtgcaccccttgttttttcggcgtaaatgcaacgacaatatagatgaccgcaatcttgacacaaacataacggacgatccattcccggaataaaacggtgctccatttcagcggcccgggatggttcagcggcacaaccctgaggccaaacaccattttcccaagcgtctggccgaaaaacttcgtcattagaacgaaataaccgtaaaatacaagggctgatgcgatcgtaatcggcgagtaaattttttcgtctgtaagggacaggccggaaagccggaaaatgggatggatgaccagccactttacacttgccacaacaagcagatcaagcaaataggcccaaaaccgcatccaaaacccggcataacgggccccggacaactccccgcggttttgttccgtcccagggtttaccgcctcaggcatttggttttcgtttgaattcactcaagttcccccccttattcagccccggaatacaggtacatcaggcgcggggcgttcgattgcgacagtaaacgcgcgagccctgaggcttctgcttctttgccgagaattttttgcgctgaagcggaaaacagcgacccaaacccgccgcttgattcatattccacaacctgtgcttttccgagatgaagatcttttttcatcgctgcaatggtgtcgtctaggtaaccgtatttgtcaatcaaatgcaaatcgagcgcctgcctgccgtcgtatacacgcccgtccgcaattttgcgtacctgttctttcgggatgtggcgcccttcggagatgactttgacaaaaccgttgtacgaattgttgaccattttctgcagcatttctttttcgctcttcgtcatgtcccggtaagggctcataatgtctttatactccccgcttttgataaccggaaaatcaatgccgtattttttggcaagcttcccgtagttcacgctttccatgatgaccccgagcgacccggtcaaggtttccgggcttgcaaatattttatcggccggcgttgaaatgtaatatgcaccggatgcgcaagtcggccccatggacacataaattttcttcttcgtatctttttttatttccatcaggcggtgatggatttccgccgactcggccaccccgccgcccggcgaatttatatgtaaaatgatgccttttacatcgcggtcttttttcgcctcatccagttcttccaaaaaactttgatggttatattcaccggtatccagcagggatggtgacgcgccggtatcctgaatcgtcccgttcacattcaaaacgacgattttctttgattcattcccatcctgcaatacattttcggaaacatccccttcccccgcttccaccgtctctttaaagattttggaaaagttggttggtgccgccatgctcgccaggttcacaataatggaaacgacgaacagcccgcctgccaaagcaagcgctccccatctttttttgttcatgccaacatttcatccttccacttttttggttttcttctattctacttgaagatccgggactttaaaacaaaaagccgggaatttttttgaaaaaaatgtccggcttttgtttcttatctattccattcctgctgcctgagctcgacacggcggattttgccggaggccgtttttggcaattccttgataaattcaatcgcacgcgggtatttatacggcgcggtcaattgttttacgtggttttgcagttcttttacaagccctggcaaattctcgctgatgccatcttttaaaacgacaaaagctttcacaatgctgccgcggatttcgtgcgggcttgcgacaacggcacattctttcacatacggatgcttgacgagggcatcttcgacctcaaacggcccgatcgtatagccggaagaaataatgatatcatcccgcctgccttcaaaccagaaataaccgtcctcatcttttcttgccctatcccctgtaatgaagtaatcgccgcggtattgcttggccgtgcgctccggctctttataatagcctttaaaaagcgcaggcgtgtctctatggacggcaatgtcgccggtttcgcccggtttgcacggcttcccgtcatcatttacgatttcgacttcatttccggggaacggtttgcccattgaacccggtcgcaacggggtatcaagggaaaagccgacgagcagcgtgctttccgtctggccgtaaccgtcgcggatcgtgaggccgaaatggttttggaaaacatccatgacttcgcggttcagcggttccccggctgagaccgcgctccttaagcttttcagatgataatgggacaagtcatccacttttgccattaaacggtattcagtcggtgtgcagcagagcacattgatttcatattcatccaaaagggacaaatattttttaggatcaaaacggccgttgtaaacaaacccgattgcgcctgaaccgagaacggaaaggaacgggctccatacccatttttgccatcccggtgcggccgtcgcccaaacgcggtcgccttcctgaatgccaagccagttcggggcagccgtgcgcaaatgggcatatccccagctgtgcgtatggatgacacctttcggattgccggttgtcccggaagtataagacaaaattgcaatatcatcttttgacgttttggcgatttccagttcacaaggcgctgcttttttcttttcatccagaaacgcccatcccggttccggtgctccaattacgaattttttcaaattttcaatgccgcggacatctttaaactgtgcggtgcatgaataatgggcgacaacgccttttacatcccctgcttcgatgcggtagtcgaggtcttttgtccgcagcatttccgaggccggcaaaaggacgatgccgcatttcattgcagcgagatacacttcgtatgcttctacaatgcgcggaaccatgacaagtatgatatctccctttttcagcccgctttccaaaaagacatggccggtccggtttgcattttcaattaattctttatatgtgacttctctgtgcatgccttctttgtcttcccaaatcagcgcaactttgtgcggatcccgggcatatttctcaatttcttcgactatattgtatgtttgtggcgcaatcaggtcactacgacgcaagcgaatcgcctccagaattttttagtacctcattattatacctgatattaaaaaaatatgatacagatttacgccaaaaacaagaagaagcggacccgcttcaggcccgcttctttatccattcttcattcagttatcgggaagtaccgcctaattgttgttcagccatcgaaacaaggcgtttcgtgatttcgccgccgacagacccgtttgcgcgggaagtcgtatcagcaccaaggtttacgccaaattcctgagcgatttcgtatttcatttggtccagcgcttgttcagcaccgcttacaagcaattggttgctgttgttgctttgtgccatgtgtctcacctccttgtgagtatagattgcgcataaacacatggcatcatgttgtaagtttattggcggtgctgccagttactggattttataacagcccggaaaagtcttcttcctgcgccgtttcatttggtgtaataaagacgtcctccgtattttgcaccgcttcttcaatcaatggttccagttcgaggcggctttcgtaaagacgcgcaagctcgagtttcggccgcgttttcggcgaaggcggcgtgaaaatcgtgcagcagtcttcatacggaaggcttgagatgtcgtaagtgccgattttttgggcaatatcaataatgtccagcttatccattgaaacaagcggccgcaacaccggtgtcgttgttacgtcattgattgcaaccatgctgtcgagcgtctggctggcaacctggccgaggctttcgccggttacaatcgcaagcccgttatggattttacggagccggtcggtaatctcaagcattacccttctttgcacggtcatcgaatagccttccggaacccctttatggatcgtctcctggatttttgtaaaggggacaatatgcactttcatggagccgctgtaggcggaaattttttgcgcaaggtcaagcgctttttgctttgcacgcgggcttgtaaacggcgggctgtggaaatggaccgcttccactttcacgccgcgtttcatcgcgaggtatcctgcaaccgggctgtcaataccgcccgaaagcatgagcatcgctttgccggacgcaccgacaggaagcccgccggatccttttatcacttcagtggacaaataaacgccgtttttccggacatccacaaacagctcgatatccggctgttttacattgacttgaatgccgtccagctgctttaaaatatagccgccgacaagatggttcaaatcattcgaatcgtattcaaatgttttatcgccgcggcgggctgacactttgaaggttttgccttccgcaaaattttgccggacgagttcgagccccgcctgctcgatatcttcgagctgtttccgggtgcggacggccgggctgaacgactggatcccgaagatcgattttaaaataccgatgacttgcccgccatctgcgccatgcaaaatcacgtacattcggtcgtacagcgcctggacttcaatgccgccaaaaggcctgagcgcttttttgacattgtcttttaaatgccggataaaaaactggcggttatgcccttttgtcgaaagttccccataacggattaaaatgcggtcatagttcattgatttctccccaacacttgttgtaaatttgtgattgtttgccttaatatgcggataaaacgttccgcttcctccattgtattttcataagaaaggctcacgcgcaccgcccattcggcttcgtcttcggaaacccccatggcaagaagcgtgcggctcagttcccgcgtttttgaagagcaggcgcttgttgtggaaatataagtgccttcctcttcaagcgcatgcacgagcacttcgccgcggatgccgcggacggaaaaattcaggatgtgcggcgctgaaacagccggattggtatggactgtcacagcaggcatctcctgaagtttttcgatcagggcatcccggatacgggccgttctttctgccgccccggcttcaaatttttcatggaccaggcggagcgcttttccggctgcaacgattccgcctgtattttcggtgccgctgcgcaagcccctctcctggtgcccgccggttaaaagcggtgacaggcggagatttgcccgtttatataatatcccggttccctttaagccatggcatttatgcgcggaaaccgtgcaaagatcgatgccggcctcacgcagggaaagcgggacttttccgcagccctggacatcgtctgtatggaacaggattttcgggtaagttttgagaagctgtccgatttcttccaccggctgcactgttccgacttcgttattcacatgcatcacggaaacaagaatcgtttcatccgtgatggcctgttttaaatcgtccagtttgatccttccgctcttgtcaaccggcaaatacgtgacgcgaaagccccattcttccagctgccggcacgtttcaaaaacagatgcgtgttcaacagccgtcgtaatgatatggcgcccccttgaacggtatgcgagggctgtccctttaatggccagattattgccttccgtgccgccggatgtgaaaaaaatttcgttctcgtctgcgccgagaatacctgcaatttgccgtcttgcctgcgtgagaagtttctctgtacgcgcgccgaggctgtgcagggaagagggatttgcaaaatagttttccgatgttttcacaaaagcatccagcacttccggataaggcttcgttgtggcactgttgtcaaagtaaatcatttgaacaccctctgttggcataaaattggatccaaacctgcatcattgcttaatataccatgccggataccgaacctacaaccgatatactcccgttatgcaacacccattccggtctccctgccgcttttttgcggcaccggctttaatcttcaaaatggggtggtaatggtcctgcgccttccgcccgtgcgtggttaacccgttcaggcagaaatgcgtcgcttaaggctcaaaggtcttcacccgtacctgtttaccaggctaaagaacccggcgtcaaaacgaatgcgtgcgtccggctgaaaggcatggaaaaaagcaaacgaaaaaaacggggagcgctccgtattttttccgtttgctttaaagtaattcttccgtttccagcattttttcaatttttttcaatgcaccaggctcaaccgcctccactgtcgttgcggcttcttcaagcgccttctcataatcatagcgccggaaagctacttctgcgcgctccagcccgtccgccactttcttatatttagcacggtaacggttgccgtattgaatcactttttcagcaagctgaacattttccaataaagctttcgtgcttttttcaaagtttccgactgcctgttccgcctccagcagatggtggttgaccctctccatgtttagcggcgtggcatggaggctgtcggcagtatcacgaatcgcgttccaggccgcttcatacaggctgcggtacgagtccggcagcccggggatattgcttctttcgacaaggcggcgcatatcctggattttccgcttcaatcccgcgatcttcgcgcgtgcctccatttcttccttccgcaggttctgcagaaattcgttaaacgtcttctggtcatcctgcagtttttcaatctgcccttccatttctttgagctgttcgcttaacacggtataaatcgtttcgttttcgggaatttttacttcaaggaccgccaaacgcgcggccagtttctccaactgtttatcgagttcagcaggaacggccatgttttcctcatgcagctggtatgtcttttgcacggattctgtttctgttgtgaggcgcttgttttcttcccgtacttcatccagcatatccttcacttcgcggaaatgcttgagcacatagttttttgcgtacgcttctttttctaaaacatcgtaaatcgtttctattctttccttgatttcccggatgccttcctcgacatccgctgtgtcagcctgttcaagttgtttccggtaagccgatagcttttctgtaagctccttcatttcttcatcaaactgcaggtgatcgagcgcaaagccttgtgcagccatttctttgtagccctctttcaattcagcaaactgcatcggcaaaagcgattccgtttccgccagcaaatccggaatttttccggcatcctcctgcaatgtttctgtttcagttttcagttcatcggctaatttctttgcctccaaatagttcccggcttccgtcaattcatggtaacggacaaatttctccgccaggctgtccactctcaggtcgaggcttttaatggcttttccgaatgtatggcgccgtgtcagaagctgtttcttcaagtctttgaagattttcccgagttcttccacttctttccgggattctttctcggcatccatcagttcattgacgccgtccagtatatcttttattttttgttccgcagtttgaagaatcgcctctgcttccgcctgtacggccttcgcctttttgaaacggtatttgtcagtgtgctcctcgatttcaaagagcttatcttccactgccggcagttcctcgtttaaaaggtcctcccagtctttgcgccagccttcaaataaactttccgcctccccgcccatattgagccgtttgacttttcccagctcatcggtgacaggccggttcatgatttcaattttccatgcttcaagcttgtcaatctctttgtaaaactgcctcctgataaaaaaaccgcaagtcaataaaaccagcaataaaagaatagcgccaatgatgccatacatcataaacttgaaagcctcccgttcgtccacaaatcaaaccttaatatccgctcattatgtatgtatgaataccggaacaatccttcccgatacccacaggcatgtatgtttatttttattctatgataccatgtaatgacaatatttgactatgaaattcgagatttttcgattcattttggggaaggttttttccgtacccacaataatttttacatggactattatgccagccggttggaggaggatcacgccggtattcaaaacccggtcacgcaaacgggagaattgcaccgaaaggaaaaaatcgcatacggtgcaggggacatcgggtataattttctgtttgacctcgggcaaatctatttgctcaagttttacacggatacgctcgggcttccggcttccattgcaggaatggtatttttagtgacaaaaatttgggacgctttttcggattttaccattggcacggttgtagaccaccggaaaaaaattgggccaaaagggaagttccgtcccttcattctgtataccgcagttccgctggcgctgatgacgattacgaattttctttctccggatttttcattaaatggaaaagtgatttgggcctttgctacatacatggctttcggcaccatctacagcatttccagcataccatacggttcaatggctccggcaatgacgaaaaatcctaacgaacgggctgaattgtccgcctttaggcaggccggcgctaatcttggattgctcattacgacagtcggttttatgccggttgtcctcctgtttgataatccgaaaatcggatatccggcagcggctgcgatttttgcaacggccggcatattgctgcaaatctattcttataagcatataaaagagcgccatgtcgaactggaaccgaaaaaaacaagccacacgataaaagacagctacaaggcgcttgttaaaaacgggccccttttcattgtcagcctggtcaatttatttaccatttcagcttacaatgtgaaactggctgttcaggtgtattactgccagtatgtattgcacaatgtcaccatcgtttcttatatgggattttttagtatgggttgcgcatttttcgggattgccctcgctccttttgttcaacgaaaaatcgggaaaaagtacacgtatatgatcggttgtgccatttgggcggttgccgatctgcttgctttgttttttgcccataatgccgttctgtttattgtatttgcctgcctcgcctttttcggaaacgcttttgtcaacagcctgaactgggcattgatttccgactgcgtggaatacggggaatggaaaaccggaaagcggacggaaggtattgtctactccttttttacattctttcgcaaattgtcacaggctgtcgccgggtttattcccgggtttgtgctgagcatttccggatatgtaccgaatgccgtccagtccgcaagtgccatttttggtatcaaagcgcttatgtttatctatccggcagcactgtccattttaacgattgttgtcttcggctttttctaccgcttgacggaaaagaaatataaagaaatcgtggcggagatgaatagcaggtaatgcaggtcaagggagcagtttcaacaagcaaacgtccaattttggaatgaacaaacagggaattggaaagaaaaaatgctgatttggaaagaaaaatacagattttggaacaaaaaggaaagtccggaaagcaagatttcaagtttaaatgaattgttcgggaggtaacaggcaccctcccgaatttggagtgaaaagccgcctctttccaatatacaacgcaaacttttcatctgcaaagtctgcgttgtatattggataaaaatcacataaaactgtcgtcaatgagaccgttctccagttcctttttcaacgctggaaaagtgacttctttgaactccttgttcgtccggatcagcttttgccaaagtatacgttgccttagtgtagctgaatccaagcctgtgtaacatcttagaaacacccttgggagtaaaagactgctgaaactcttgttgaatccagtcggcaattaattggagcgtccaagtgtattttgcttcgaaaccgacttctgcaggtgttttattcacgatggtatcggccaactgtttctgttgttctttacttaacttttcgggtttacctgttgtttttttcatttgtagcccggaaattccaccttcttcataagaatgaaagtatgccataaccgtctgccgattacgtcctataatcttagcgatatccatataagtagggcttgctgaacgaatccggttctgaatttgtacccaatttgtctgcaaactccatcgcaaaatatatgcgaaaatgcgtgagtttgtcttctccggacgttgaatcggctttcgcgtgcaggcatttccctggatttgttgtaaaacctttgcatttaaatggttgccaaagctgtcagcatccttgccaaatctaggaatttcgcttattcagcaagccctaagtatggccttctaggtgtaatagcacagaaaggtaacgctcataaagacgtttatcttttgtatttttcattgcatttcgtaaggattcaatttcttgttttaccattttttctccatcctttttggtatcattacagactttatacccgaaaaaggaccaaaaaattgagcaaagatgattagttcatcttatataacttaagttttatcaatggacggttcaaagagaactcgctgtggaaatttcaaccggagttttaaaaggcgcagcatttggcctatatgttaaaagcatttccgaggaacaatgggatatgcgaatgccgggcattttttcattttaatggatatagactagtctacggtttccgagtttagaaaaagaagaaggtgaattccaaaatctttctggttttccagaataccattataatagagaaataagcaatgatcaggagaggatgttaacgttgagtgaatatcacattccggagaaggtccagatatttggaaaagatattcggaaagagcaattgaagtatcatcataagagaacagctgtgacaaaggcatttactttcgatgctgcccatcatttgcatttgtatgaaggaaaatgcaaaagcttgcacggccatacatacaaagtaaaaataacatgcagtgcgtacttaaatgaaattggcatcagcatagactttggcgatctgaaaaagatatttcaggaagcggttgaggaaaaactggatcaccaatatttaaacaacgttcttccgccaatgaacaccactgtggaaaatatggtggtctggatgtgggaagagattgaaaaccggcttaaccggcaaaaagattacaaagaccggggagcgagattggaagaactggtactctatgaaacaccaaaaagttatgcaacgatgaaacgggaatggatggaggaagaaacagatggcaagtaaaattccggtgatcgaaatatttggtccaacgatacaaggggaaggaatggtcatcggaaagaaaaccatgtttgtccgcacggccgggtgtgactatgcctgtagctggtgcgattctgcttttacctggaacggggaggaaaaaggccggattgcgctgatgacggcggaggagatcttccagaagctgaaagaaacaggaggagaaaactttagccatgtcacgatttcgggaggcaatccacttttgttgaaaggccttggcgaactggttgatttgcttaaaacccatcaaatccgtacagcagttgagacacagggatcgcgctggcaaaattggcttccggacgttgatgatgtaaccatttcgccaaagccgccgagttccggcatgcacacagattttgagactttggataggatgattgaacagctaacactagcgggaagccatttttgcttaaaagttgtcgttttcgatgataaggattttgattatgccaaaaagatccataaacgctatcctgttgtccccttctatttacaagtcggcaatccggatattgctttgcccgaccgggatgcgttagcgaaaatgctgatcggaagatacgaatggctggtgaatctaaccttgcaggcagaagaaatgaatgatgcttatgtccttccgcagctgcatgcattggtgtgggggaacaagcggggcgtataaaaaagatgttatttttattataggatgcaaaaaaacggtgagacacgattaatggcggtgtctcgccgtttttttgtcagcggcttcattcaaatgttaaggagtcgcggaaaaagaaagtccttccttaacctagagcctgtctacgttaagaaagcaagcaaaaacgaaggccttccttaacatagaatgcatctatattaagtaagcgtgaaaaaacgaagtcctttcttcacatagaggacgtctacgttaaggaagtgcggaaaaaagacggccttttttcacctagagggcgtctacgttaaggaagcaagcaaaaacaaagtccttccttcacctagagcccgtctacgttaaggaagcgtgaaaaaacaaagtccttccttcacctagagcctgtctacgttaaggaagcaagcaaaaacgaagtccttcctttacatagcccccgcctatgttaagaaaccgcagaaaaacaaagtcccttcttaacatagaatgcgtcatcctcttcttgttgctttcgcttttcatcatgtgtccttgtcatcggtaccactttacctgttcgctggccgttccctctttttctcacatatgctggcttgcggccggttttgtgtcgggattgactgcctttttatctttcattcggctgtagatgtttgcgagcaacgaaccggacaaattgtgccagacgctgaaaatcgcgctcgggacggcggcaagcggggaaaaatgcgcggtggccagcgcaacgccgagcccggaattttgcatgccgacttccatcgaaaccgctttttgcttggcaaggtccatcccgcacaaacgggcgaagaaaaagccgatgataaagccaagcaagttatgcaaaatgacgacggcaaaaacgagtaaagccgtttgtgcgattttttcggcgcttccggcgaccactcctgctacaatcagcacgatcgccacaaccgagacaagcggcatcgcttttgcaccggcgcgcgcctgtttgccgaaaaactttttcacgataaacccgagcaaaagcggcacaatgatcacttgcacaaccgaaaggaataaagacaatacactgacatgcacccatttgctagcaaacagcaggattaaaagcggtgtgacaatcggcgcaagaatcgtggacacggaagcgatcgcaacagcaagcgccacattgccgcgtgcaagaaacaccattacgttcgaagccgtgccgctcgggcagcagccgacaaggatgacgccgattgcaatatctttcggtaagttgagcccgactgcaagcagaaaagcgataagcggcatgatgacaaaatggccgaccacgccgagcgccacctcaagcggctttttgaaaacttctttaaaatctgataattcaagcgtcaaccccatgccaaacatgacaattcccaataaaggtacgatataattcccgatccacgcaaaatgctgcggtaaaaaataagcgatgactgcaaaaatcagcacccatacggtgaacgttttccctgcaaacgcgctgattttttctaaagttgccatgtgaagacctccaaatataaattgttttctaaaatgatagaatatctgacaaaataaatcaaggcagccatttcaatattttgggatttatttagatcattcgtttccgaaaacatttttttcaccaaaaaaaacagcgcaatgcctgggcctgcgctgtttacaacatattccgtgtttttcatgcatccttcgtttttttcatggccagcactttgtcggtatccggtgtgacataaacggtttgttggttctcgtaaatgacaaatccgggttttgcgccgttcggttttttcacgtagcgcactttcgtataatcgaccgggacggaagcggactggcgcgctttgctaaaataggcggcgagtgatgcggcttccaaaatcgtttccggcgccgggtttttgctgcggatgacaacatgcgacccgggaatgtcttttgtgtgcagccagatttcatcgcgggcggcgacccggtttgtcaaataatcgttttgcttgttgttctttccgacaagaatttccgtgccgtccgaagcctcgtatttttcgagggcgattttgtttgcatttttccgccgggcgcggctgtgccgttttttcaaatagccttcttcttccagctcttcgcggatttccccgatatctttcggcgaggctgtttcaagctgctggaggaggttttcaaaatacagcacttcatcccgggcttttttgatctgttcacgcacggcgacttgcgcatgcttcgctttctggtagcgggaaaaatagctttgcgcattttcggcaggggtttttagcggatcaagcggaatttcaaccattgccccgtcctcatcgtaatagttttgcactttcactttgtccatgcctttttttacagcatacaaatttgctgtcaaaagttcgccgtacagctggaactgttcggcattttgcgcttccgcaagcgtgacttccagctttttaattttgctttcgtttttctctagttcatttttcacaaaccgctcaagatcgtggcctttttgcttgacgcggtcacgttcggctttaccggcataaaaacggtcaagcagcgcgcttaaagtcggaaacgttttgacttcgccttcaagagacgtaagcgggatcatgtagaacgattctttttgcgtgccaatgatcatcactggctggaggtcaaactttttaatcggctccataacggacaaaaacgcgtccgtgaccgcatctggattcgaaaacttcgcccggtgcatgatttctttcgccaaaagaggggagacgccggcaaattgcgcgacaatttgcttgtccattttcccgctgttccagtcaagcgctgctatgacatcctcttttgccgcctcaagcgggttccgtttgtgttgttcagggggcatgacatattcatgcccggggagaatcgtccggtacgtattcacagccggtgggacatgtttgatgctgtccatgatcaggttccgctctttgtcgaccaagatgatattgctgtggcggcccatgatttccacgtacagctgtttaaaggaaatatccccgatttcgtttcggtttttgatgtcaaagacaacaacgcggtcaaggccggcctggtgaatatcctcgatcacggcaccttccagatgttttcttaaaagcatgcaaaacatcggcgggtcctgcgggttgtcaaatggttcatccgtcagctgaatgcgcgcataggccgggtgtgccgacaaaagcagccgcctgttttttccgtttgcacgcaccacaaggaccagttcattctggtacggctggtggattctgttaatccgcccaccttttatcgtatcaacaagttcttttaccatcgctcttgtaaataatccgtcaaatgacatatcgcattcctcaattctttcgcgcatgcataaagcattgcgtcagtcgttggcatgttaaattatatcatttttttggacagggctgaatatgttgctattaagacaataatgggcagaagcaggggagagtgtattttcatgatgtttcacgaaatgagtgaaaaagaagtagaacaggaattcggaactgatctggaaaaagggctcaccgaaaaagaagcggaaaaaagaatcaggcagtacggctttaatgaactggaagaggcggaaaaggaatctgcccttatgctctttctcagccagtttaaagattttatgacgctcgtcctgcttgccgcaaccgtgatttccggatttctaggcgaatatgtcgacgcggtcgccatcatcgccattgtattgattaacgggtttctcggcttttttcaggagcggcgggccgagaaatcgcttgaagcattaaaagaactttccgcaccgcaagtcaatgtgcgaagaaacgggcgatgggtaaaaatcccttccaaagaagtgacgcttggtgatattttaaaatttgaaagcggggaccgggttggcgccgatgtccggattgtaaaggccaataatcttgaaattgaagagtcggcgttaaccggagagtccatcccttccccgaaatcaacggaaccgattcctgtggaaaatgcgggcctcggcgatttgcataatatggcgtttatggggacaatggtaacgcgcggcaacggcatcggcattgtcaccggcatcgggatgcagacggcaatgggggaaattgccgatatgattcaaaacgccgaagcgatggcgacccctttgcaaagaaggctcgagcagctgggaaaaattttaatcgtggtggcgctgcttttaaccctccttgttgtccttgtcggcgtctggcacgggcatgacttgtattccatgtttctggcgggggtttcgctcgcggttgcggcgattccggaaggcctgccggcgattgtgacgatcgcattatcgctcggcgtccagcgcatgatccggaaaaacgcgatcgtccggaaactgccggctgtggaaacgcttggctgtgcgtctgtcatctgctcggataaaaccggcacaatgacgcaaaacaaaatgacagtcactcatttatggagcgggggaaagacgtggaaagtgtccgggacgggctatgagccgaaagggatttttacggacaatggcgcggaaatccacccgttaaaggaaaaaagcgtctaccagcttttgacgttcgggctattatgcaaccatgccgaattgaaagtgaaaaacaaagaatatatcatagacggcgacccgacggaaggcgcgctcctcgtttctgccctgaaggccggtttaacgagggaattactgctgaaagaatttacgattgaacaggaatttccatttgattcaacgcggaaaatgatgagcatggtgatccgtgacaaacacggcaaacggtttgtaatcacaaaaggcgcgccggatgtgctgcttggggtaagtcggtcggtgctctggaacggcagggaacagtcatttgatccggcaacacggagaaatgtagagaaagcggtcgaatctttggctgcccaggcgcttcggacgatcgccatcgcgttcaagccacttgcagcaggcgaaacggtaaaaaatgaacaagaggcggagaaaaatttgatttttcttggcgtccagggaatgatcgatccgccgcggccggaagtcagacaagccattaaagaatgtaaggaagcgggcatccgcacggtgatgattacgggcgaccatgcggtgactgcaaaagcgattgcgagacagctcgggattttgcgcacaagccgtgaaaaagtggtggacggcgcgatgctgaacgaactgacggtggatgagctggaagacgtgattgacgaagtttccgtgtttgcacgcgtatcgccggaccataaactgaaaatcgtcaaagcttttcaaaaccgcggggcagtcgtcgccatgacaggagacggcatcaatgacgcaccggccataaaaacggccgatatcggcatctcgatgggcattaccggaaccgatgtcgcaaaagaagcgtcctcgctcattttgctcgatgataattttgcgacgattaaagcggcgatccaggaaggccgcaatatttacgaaaatatccggaaattcatccgttacctgctcgcttccaatgtcggcgaaattctggtcatgctgtttgcgatgcttttgtccctgccgcttcccgtcgtacccatccaaattctgtgggtcaatctcgtgacggatgggctgccggcaatggcgctcggtctcgaccagccggaagaagatgtgatgaagcggaatccgcgccatccgcgtgaaggggtgtttgcgcgcgggctcggctggaaagtgatttcgcgcggttttctgatcggaattgcgacattggccgcttttgtgaccgtatattaccagcatcctgaccggcttccttacgcccaaacgattgcatttgcaacacttgtccttgcccagctgatccatgtgtttgactgccgcagtgaacgctcggtgcttgcgcgcaatccgtttggaaacgtctatcttgtgcttgctgttttgtcatcggtgttgcttatgcttgccgtgatttatgttccagccctccagccggttttccatacacttccgattttgccaaaagactggctgctcgtcctctgcatgagtgcgattccgacatttttgcttgcggggacctattatttaagaaaaaaaccttaaattatgctataatcttaaaagtaataggggatcctctattactttttcttttggcgaagtttcccccggcgctccggttaagattttctttcctaattgaacggggcgcggtataatctccgtaaaagcttttttgattgagccaggaaaaggcgcgatgaaagccgtgaaggttaaaaccggcgcgataaaaccggcgcgacggtagatgtaagaagagattgggcgtgagaagatggtcttaagcatgacgggctatggcagaggccgccgaaagacgcaacagttcagtgtgacagttgagatcaagtctgtcaaccatcgcttttgcgaatatcagatcaggatgccgaagcagcttgtcaaagtggaagaagagttgaaaaaaatcatcggaaactatgtgcagcgtggccgtattgacgtgtttgtcaccattgccggtgaagggcttgtcaaacgcaggctgcgggtcgactgggatttgctggacgaataccaccggtttttaagccggatccgtgagcaatacggaattgaatcaggttttggcattcgcgagttattaaaccgcgaagatttagttacaatagaagaaatagaggaagataatgaagaaatcctcacccttgtcttggaagcctgcaaagaggcggccggacagttgcggcttatgcgcgaaaaagaaggttccctgctcaaagccgatttggaaaaacatctccaaacgatttcaaagttggtggacgatatcaaaacagaggcgcagtcgctcgtttctacataccgattcaaacttgaaaagcggatgcaggagctatcaggcggccggctggatgaagcgaggctcgtccaggaagcggcgctgtttgccgacaaatccgatattcatgaagaagtaacaaggcttgagagccacttgattcaatttggcgaaacgttggcgcttcatgagccaatcggcagaaaactgggtttcatgatccaggagatgaacagggaagtgaacacgatcggatcaaaagcaaatgcttccggtatttcaacagccgttgttgagctcaaaacggtcattgagaagatgcgcgagcaagtgcagaatatagaatgattcgcgcgaagttaattgtatgcgagcgggagaggatgcaggtggtaaaactcattaatatcggctttggcaatatcatttcggcaaaccgcatcatttccattgtaagcccggaatcagcgccgattaagcggctcattcaggatgcacgcgagcgtggcactttaatcgatgcgacatacggcagaaaaacccgggcagtggtaacgatggacagcggccatgtgattctctccgcagttcagccggaaacagtggcgcaccgtgttacggacggggaaacagatggcgaggaggtatagcgttgaagaaaaaaggattgctcattgtgttatccggtccgtccggtgtcgggaaagggaccgtacggaaagccattttttcgcagccggatacgaaatttgaatattccatctcaatgacgacgagaaaaccgcgggaaggtgaaatcgacggggtggattattttttcaaagaacgcgaagaatttgaagaactgatcaggcagggaaaactgctggagtacgcggaatatgtcggcaattattacgggacacctgtcgattatgtgaaggaaacattggaagcgggaaaagatgtgtttctcgaaattgaagtgcagggcgcacggcaggtccgcgaaaaatttccggacggcttattcatttttcttgcgccgccaagtttgtccgaactggaattgaggattacgcagcgcgggacggaaacagccgaaaggattcgcgaccggatggaaaaagcccgcaaagaaatcgaaatgatgaatttatatgattacgtcgtggaaaatgatacaatagaaaacgcctgcgaaaaaatcaaagccattgtcgtcgcggaacattgccggacgacacgcgttgcgaagctgtataaaaaaattctggaggttgaataagatgctttatccttccattgatgaactattgaaaattatcgattcaaaatattcccttgtcacgatcgcggcaaaacgcgcccgccagctgcaggacgagcataacgaagtacttgaaaaatatgtttccgataaaaatgtcggcaaggcgcttgaagaaatttatgtcggcgtcctccggatcaaacacgatggaacagcttcttaaggcatcctggcgcgatcatacggaaaatcacagagcagggactggcggatatggcgtcagccctttttcttatatttgcttttttgttagaatggtcgtaaggagtttgactgagattttacagggggcatatggatgcttggaaaaaatatactattgtgcgtaaccggcgggattgccgtctttaaagcggctgcgctcacaagcaagctggcgcagtccggtgcacatgtgaaagtcatcatgacggaatccgcctgcaagtttgtggcgccgttaacgtttcaggcgctttcccggaatgaagtgtacaccgatacatttgatgagaaacacccggaaaaaattgcccatattgatcttgcagactgggcggatcttgtcctcgttgcgccggccaccgctaatattattggaaaattggcgaacggaatagcggatgatatggtctcgaccacgattctcgccacgaccgcgccggtatgggtggcgccggcgatgaatgtccatatgtatggccacccggctgtccgccggaacctggaaacgcttggaagcttcggctaccggctgatcgagcctgcggatgggcatctcgcatgcggctataccggaaaaggaagattggaagaaccggagaacatcgtggcgcttttgaaagattttttcagcggtggcggaccaaaaccgttgtccgggaaaacggttttagtgacagccggcccgacgattgaaaaaattgatcctgttcgctttctttcaaaccgttcgtccggaaaaatgggatttgcgcttgccgaagaagcggccaatatgggggcaaacgttttgcttgtcacaagtgtggacaatctgacaccgcccgccgaaacggaaatcatcaaagcggagagcgcagaggagatgtatcatgcggttatgggccgctacaaagaagcggatatcatcattaaaagcgcagccgtggcagactacacgccggtccgtgtttttgataaaaaaatgaaaaaacagccgggcaacctgacgctggaattgaaacggacaaaagatattttaaaagaactcggcgaaaggccggacaagccttttctcgtcggctttgccgcggaaaccgataatctcgaaaactatgcgcgcgacaaaatggaacggaagcgtgcggatataattgttgccaatgatgtgagccgggaaggcgccggctttgccggtgataccaatatcgtgaccatttttaaacgcgacggctcgaaacgggaactcccgctgctttccaagcatgaggcggcaagggaaattttgcgcgaaatctgccgcgagatcgaaaagggcgaaaagaaatgaagattgcaaatgtgattgtcgatataccggcaatgcagacagataaatattttgattaccggatcccggaaaaatgggaaacggccattcagccgggaatgcgcgtcattgtcccgttcggcccgcgtacgatccagggatttgttgcgggcataaaagaccgttcagaagtgaagaacttgcgtgaaatcattgcgccgcaggatttggccccggttttgaatgcggagctgcttgcgctcggggactggcttgcgaaggaaacgctttgcctgaaaatctccgcttaccaggcgatgctgccggctgcgatgaaggcaaaatatgaaaaacgcatcaaaaggcaggacgggggcgccaacccttttcttgacgaagtgtttaagggtcatgacgaaatcagctggaaagaagcacagcaaaagggctttctgccgtttctccaaaaagaagcgaaaaacggatcggtggaagtcgtgtatgaagtcaaaagcaaagccaataagaaaacggtccggcttattttctgcccgctgtccaaagacgagcttgaaaaacggatggaagaagtgccgaaaaatgcaccgaagcaaaagcaggtgctgcaatttttcctggaaaatccggatgctaagatggcttctcccgaactggcagaaacagccggcgtatcgcgggcggttatcaaaacattgcttgaaaaaggatggttggaagaaaaacaggaagaatcgtaccgcgatccgtatgccggccgccaatttcaaaagagcgtgccacatgctttaactgcggagcagaagcaggcaatcggcccggtcctttccgctgtccgcgaaaacagaaatgaaacgtttttgctttttggcgtaaccggtagcggaaaaacggaaatttatctccagtcgatacaggaagtgctgaaccagggaaaagaggcgattgtccttgtgccggaaatttctcttacgccgcaaatggtgaaccgttttaaaagccgtttcggcaaagacgtggcggttttgcacagcggcttatcggtcggcgaaaaatacgatgaatggcggaaaattacccgcaaagaagcgaaagtggtcgtcggggcgcggtcggcgatttttgccccgcttgaaaatcttggcatcattattattgatgaagaacatgaaaacagctacaaacaggaggacaacccgcgctaccatgcgagggacgtcgcccttttccggagcaaaaaccaccattgcccggtcatactcggcagcgccaccccgtcgcttgaatcatttgcccgcgcgcaaaaaggggtctatactttgctgaaaatgggaaaacggatgaacaaccacccgcttcccgaagtttcaattgtcgatatgcgcgaagaattgcgcgcaggcaaccgttccatgttctcaagagagctttttgaaaaattgaaagaccgtctggagaaaaaacagcaaaccgtgctgctgctgaataaaaggggatactcctcctttgtcatgtgccgggactgcgggtatgtgcagcaatgcccgaactgtgatatctcgcttacttatcaccgctctacaaacgaaatgaaatgccattactgcggttacgagacatttgtgcccgcaacatgcccggaatgcgggagttcccatattcgttatttcgggacagggacgcagaaagtggaagaggaactggggcggctgttgcccgaagcgcgcgtgatccggatggatgtcgatacaaccggccgcaaaggggcacatgaacggatgctgcaaagctttgcaaacggggaagccgatattttgcttgggacgcagatgattgcaaaagggctcgatttcccaaatattacgcttgtcggcgtgctgaatgcggacacgatgctccatttgcccgatttcagggcgtctgaaaaaacgtttcagcttttaacgcaagtaagcgggcgtgcggggcggcaccagctggaaggcgaggttgttgtccaaacctatacccccgaacattacagcatccaatttgcaggggaacaggactatgaacgcttttatcgccaggaaatgagaatgcggaaagtgggcgcctatcctcctttttactacctcaccctgattacggtcagccatgaaaatgtgatgaaagccgtgtccgcagccgaaaaaatcgcaggttttatgcggaaccgggtgtcgggcggaagcgtgattttaggcccttcggcatgcccggtaccccgtgtgaaaaatagatatcgttaccaatgtctgataaaatacaaacgggaaccgcggctcaatgaaacattatctgttttgctggaacatttccagcaccagattgcctcggaaggattaagcatcgcggtcgatgtcaatcctaatatgatgatgtaacaggaacgagtgattcgaaatgatggagattgtaaaatatcctgccgctattttggagaaaaaatgcaaacgggtcacggcattcggcccgtctttaaaagtggtactggatgaaatgtatgaaacgatgcttgaagcggacggggtcggccttgccgccccgcaagtcggcatcaaccagcaaatcgccgttgtcgataccggggatgaaacaggccggattgacctcatcaatccgaaaatcgtaacaaggcgcggggaacagacggatgtcgaaggctgcctgagttttcccggcgtttatgggacggtttcgcgcgccaattatgtgaaagtaaaagcacaggatgcaaacggaagggcgttcaccattgaagcggaagatttccttgcccgcgctttgcagcatgaaatcgaccatctgcacggcgttttgtttacgtccaaaatcattgattatgtggatgaggaagacttggtttttgaggaggccgatgccgaatgacgaaagtggtgtttttgggaacgccggattttgccgtgccggttttacagactttgatccgcgacgggtacgaggttattggcgttgtgacgcagccggataggccggtcggcagaaaacaggttttaacccctccgcctgtaaaacggaaggcggaaaagcacggcattccggtttttcagccggaaaaattgcgcgagccggaaagcctcgcccgtattttggcgctcaaaccggatgttgtggttacatgcgcatacgggcagattttgccgaaagcattgcttgatgcgcccccgttcggctgcatcaatgtccatgcgtcactgctgccggaactgcgtggcggggcgccgatccatacggctattttacaagggaagaaaaagaccggcgtcaccattatgtacatggcggaaaaactcgatgccggcgacattttcagccagcgggaagtcgaaattgaagaaaccgatgatgccggcaccctccatgacaagctgagcaaagcgggcgctgtgcttttatccgaaacgcttccgaaaatcttggcaaaagaagtgacgccggtgccgcaggatgaacagaaggcgacgtttgcccacaatattacgcgcagccaggaaaaaatcgattggaaaaaaccgggggaagtcatttacaaccaaatcagggggctgtgcccgtggccggttgcctacaccgtgcttggcggaaagacgtttaaaatatggaaaagcgaaaaagtgccgctttctgagcaggcggagccgggcaccatcgtcacgatagaaaaagacgggatcgtggttgcaacgggcaacacaaccggcattaaagtgacggaactgcaacctgccgggaagaaacggatggcggttgcacaatttttaaacggttcagcgggcggccttgcacccggaatgaaatttggagatgaagatgagtaaagatcggaaaaatgtccgtgaagcggcgcttgaacttttggaggcagtggagaaaaacgagtcgtacagtaatttgctgcttgaccgctatattgaaaaataccggttccacggtcctgaccgggcgctgcttacggaaatcacttatggcacgttgcagagaaaacagacactggactattttctcgccccgtttttgcgcaaaaaaattgaaaattgggtgcggattttgttgcgcttgtctttatatcaaatggtatacttagataaaatccctgaccgcgcgattatttttgaagcggtggagatcgccaaaaaacggggccaccgcgggatttccgggatggtcaacggcgttttgcgcgccatccagcgcggggggctcagaagtttaaaggaaatagaagacccgcttgaaagattatcggtggcaacgagccatccgcactggcttgtggcaagatgggcggaagcttatggctataaaacaacgaaagaaatgtgtgaagcaaacctgattccgccgttacagacagcaagggtgaacctgaaccgggcatccgtggatgaagtcatcgaaaaactggagcgggaagggtttaccgttgagcggagcccggttattccggaagctgtccgctcacgaaaaggcaatcttgcccgttcggcatgctttaaagaagggctcttcaccatccaggatgaaagttcgatggcggttgcctatgcgctttgcatccaggaaggccagcggattctggacgcttgtgcggcaccgggcggaaaaacgacccatattgcggaaaagttagaaggaacgggagaagttgtcgcgctcgatctccatccgcataaagtaaaactggttcaggaaaatgcagagaggctcggtaccggacaggtagaagcgattgcgatggacagccgggatgcaggcgcccgttttgaaaaaaacacttttgaccgcattcttgtcgatgcgccgtgcacaggttttggcgtgctgcggcggaaaccggatatcaaatatgcgaaaaccgttgacgatatccatgcgctaaagcaggtccagctttcgattttatcgggcgtgtcggaactgttaaaaccggacggcatccttgttttcagcacgtgcaccgttgaccgggaagaaaacgaagggacgattgaaacatttttgcagaaacatccggaatttgaaccgtatccgctgcacgtcccggaagcaatggaatcttgcgttgacggataccgaatgcagatttttccgcaggacttcggcggggacggatttttcatcgccagcatccgcaaaaaggccggtaaagcataggcttgcctgatgataaacacgtcaaagagtatgaaggtgggggtataatggaatctgtctacaaaacggacaagggcagagtaaggcagcataacgaagacagtgggggagtctttgaaaatgccggcggtgatctccttgcgattgttgcggatggcatgggcggccatcgtgcgggtgacattgcgagcggcatgacggtgcaatgttttaaagaagcgtttgaaaaattcggcccggttgccgatgcggagtccgcggaggcgtggctttccgagacgatcggcgaggtgaatgcccgtttatttgaacatgccgcccatcaccctgaatgcgaaggaatgggcaccacactggttgcagcggtctgcaccgaaggctttatttccatcgccaatatcggagacagccgcggctatatttttaatgaaaacggcttccagcagctgacggaagatcattcgctggtcaatgaactggtcaaaaccggccagatttcaaaagaagacgccgaaaatcacccacataaaaatgtgatcctgaaagcgctcgggacggaagattcgatctcgcccgacttaaaaacgattgtatttgaagaaaatgatactttgctgctttgttcagacggcctgtcgaataaagtgccgacggaagtgatgaaagaagtgctggaaaaagatctgccgcttggggagaaagcggacatgctcgtggattatgccaatgaaaacggtggggaagacaatattacgattgtgcttctttcgtccggccgcaataaaggcgggtgcccttaatgttaatcggaagacggatcagcggccgctataaagtcaaaagcctgatcggcggcggcggcacggcaaacgtctatctggcccgcgatatgattttggaccgtgatgtggccgtcaaagtgctgcgcccggattttgcaaatgagccggagtttatccaacgttttcacagggaggcccaatcggcaacgagcctggtccatccgaatattgtcagtatttatgatgttggcgaagaggacgatttaaattatatcgtcatggaaaatgtcgagggcatgacgttaaaacaatacatacagcaaaacggcccggtttccgttgagaaaacgctggacattatgggacagcttgcagcggcgatcgcacatgcccatgacaaccatattatccaccgtgacattaagccgcaaaatattttaatcagccatgatggcgttgtgaaaattacggacttcgggattgccatggctttatccgctacttcaatcacccggacaaatgccgtgctcggttcggtccattatctttcccccgagcaggcaaggggcggtgttgccacatataaatcggatatatacgcactcggcatcgtgatgttcgagcttttaacgggaaggcttcctttttccggggaatctgccgtttccattgctttaaaacatttgcaaagcgagacgccgtcgccgaaaaggtggaatcccgatattccccaaagtgttgaaaatattgttttaaaagcaacggcaaaagatccgttttatcgttataacagcactgaagaaatgggggaggatatccgcaccgcactcctgccggaaaggctgaatgaaccgaaattcgtcatcccagaagacgaagatcagacgaaaattatcccggtgatttccgaagtggctgccggccccgaccggaatgaagaaacgattatcgcaaatccggccggggaaaacgaaaaagaaaagaaaccggacacaaagcgggacaaaaaagagaaaaaacggcggaaaaaatggccattcgttgtcggcacccttgcctttttggtcgtgcttgccggccttgccgccttgttgctgccgtccctgctcggcccgaaaaccgtcagcgtcccgaaagtatcaggcaaaacggcggatgctgctgccgccgtgcttacggcgcatggtctgaaaaccggggagaagattaaaacaacaagcgaaacggtaccaaaggggcaggtgatcaaaacggatcccgaagccggggaaaaaatcaaagaggggacaaaagtttccctttatatcagcacgggaaaacaaacctttaccctgtccgattataccggcaggcagtttgacgatgtcgtgaatttattgactggggaacattttaaagacatcgataaagaagaagtatacgatgacagtgcgcaagggaccattatatcacaggatcccgcgcccgataaaaaagtggtgcccgaaagcacggtgcttacctttactgtaagcaaaggcccggaaatttatgcagtcggggatttaactggattttcaaaaaaacagctggacgcatatgaaaaaacatccggtttttccattaaatatgccggaaaagattattcggataccgtgaaaaaggaccatgtcatttcgcaatccccgcagccgggaaccgagctgaaaaaaggctcggtcgtaaaagtgaccatcagcaaaggacagaaagaaatgccgccaaagacggtcacaaaggaagtaacgatcccgtatgagccggacacggattccgccgggagcacaaatgaaaacaatagcgaaagttccgggtcggacggaaacagccagtccggtgacagcaacagcgaatcaaacggaaacgattccggcggcaaaacagatgcatctgcacaagaaaacccgaaacaggaagtgcaaatttttattgaagacatgaaccattcgatgtccgcacctgttcaaacgtttgagattacgaaaacggtgaaaaaacagctggagttcacgattgaatacgggaaagaggcgacatacaaaatcatgagggatggcaaagtcatcgccgaagagaccgttccgtatccaaattaagaaaacgcgggcgtcccatccttaggcgagagcagcgccgtcgttgcatttatgcgttaggaaagtagaaattgaaaaatttatcctttcttaactgagaaagcgccgggccgtaacccggcgcctcccctggtttgaaaatgtcggagagatggaggtggatgtatggcagaaggaaaaatcatcaaggctttaagcggcttttactatgtgaaaaatcgtgaagacggcgaaatttaccaatgcaggggcagaggtgtcttccggaaaaggaaaatcaccccgctcgtcggggaccatgtcgaattccaaaaagaaaacgggcgggaaggttatattttggacatcggcgaaagaaagaatgaactcgtccgtccaccgattgccaatgtggatcaggctgttttggttttttccgcaaaagaaccagccttttctacgctgcttttggaccgttttttagtcccaattgaaaagaacctgattcggccgcttattctgatcacaaaatgcgatctcttgggcgcggatgaaaaagaaaagctgctcgagacgcttgcagtataccggcaaatcggttacccggttattttgtcgtcggcgaaagcaggcgaaggggcagatgctttgctttcggcattgaaaggaaaaatcaccgtcttttgcggccagtccggagtggggaaaacgtccattctcaaccgtctggaccctgctttgggtttaaaaacaaatgaaatttccacgcatctgggcagagggaagcacactacccgccatgttgaactattgccggtcggaggcgggctcgtcgcggatacgccgggtttcagctcactcgacttcgccggcgtggaattcacggagctcggggcctattttccggaaatcagtgaaaaatcggccggctgcaagttccgtggctgtctgcatgaaaacgagccgcattgtgcggtaaaagccgctttggccgaaggggagatcgcttcattccggtacagccattacatccagtttcttcaggaaattaaaaacagaaagccgaggtattgacgatggtaaaaatcgcaccttctattttgtctgcaaattttgcaaaactggaagaggaaattaaagatgtggaggaaggcggggcggactggatccatattgatgtaatggacggccattttgtgccgaacattacgatggggccgctcgttgttggggcggtgcggccggtcacaaagcttccgctcgacgtccatttaatgattgaaaatccggaccagtatttggaagcttttgcgaaagcaggggcggatacaatttctgtccatgtggaagcgtgcaggcatctccaccggacgatccaggaaatccggtcccttggtgtaaatcccggcgttgtcttaaatcccgccacaccggtcgaatggattgcgcccatactgggggatgtcggccttgtattgctgatgacggtcaatcccgggtttggcggacaggcttttattgaatccgttgtcccgaaaattgaaaaactgcaccgtttaaaaaaagagcaggggcttgcatttgacattgaagtcgacggcggcatccatccggaaacagcgcaaaaatgcacacaggccggtgcaacggtgctggttgcgggctccaatatttttaaaagcaagaaccggaaaaaagcgatccaggcattaaaatacgggcagtaaaacaacagccggggttcatccggctttttctgcatgaaaaacccgcggggagtggacaaagcatcaggttgtcttaaatccgtcgtataaaaggggaatgaggcatggaaaagaaaatctatattttagcaggcggcccgcccgaaaatgtgccggatcttgcgccatatgcggaggacaaacgagcggcatgggcaggtgtagacaggggcgtgctgcatttgcttaaacaagggatcatcccggaaatggcctttggcgactttgattctgtcaatcaggaagaatgggactggatcaaccggaaacttgagcatatccgcaaattccagcccgaaaaagatgagaccgatatggagctggccttaatgtgggcaatcagccaggatccggatgtgatccgcatttttggtgctaccggcggacggctcgatcatgcttttaccaatgtccttttacttgtacatgaaaaagctttgcaatttaaaggaaaaatagaaatgatcgacaggcagaatctcgtggaaatgtttttgcccggaacttatacgattgaaaaaatggatgcgtatccgtatgtttcttttctcccgttgacggaagaggtagaagggatctttttaaccggatttaagtatccgcttgaaaaccggcatattgtaaggggcaccaccctttgtgtcagcaatgaactaatccgtgattttggtactttttctttttcaagcggcatattaatgatggtaagaagccatgattaatgatatttcatgaacaagcaggctgtatccttttcgcttacgcatgaatataatgtgcgggagacccggattgtatttgaatggggagggacatacatgaaattttatacgattaaactgcctaaatttttgggcggtattgtcagggccatgctggggacttttaaaaaaggataagagataaaatggacgcatggcggttcgtagggtagttcattttacacaaagggaaaatcggcggcgcgccggttttttttcgcaaaaaaaaacaggaaaccggatgcccggcttcctgtttttgccttatacacgttcgactttcccggatttcaaagcgcgggcagaaacccagacgcgttgcggtttgccgtccaccagaatgcgcactttttgcaagttcgctttccaggtgcgtttgtttgcgttcatggcgtgagaacgtttattgccggataccgttttacgtcctgtaattgcacattttttcggcattgtattccctccttctgttgcaaagcagaaatagaacatatttatgctttcatctcttcatttttcgttaaaaattcactataataatttatcatattggaagacacaatgcaagtcttgccggtgagtatacatgcagagcaccctgttttgtggtaaactataacaatgcaggcctgctctgctttccatgtaccctgtcttatagtacaatggcggtagcaggtcaaatccggtttagaaacagtgaagataagggggagcgatttatgccgattgaaataaatacgcattacggacaaattgatatatcgaatgaagtcgtcgccacgattgcaggaggtgccgccatcgactgtttcggcattgttggcatggcctcgaaaaatcaaattaaagacggcattacagaaatcctgcgcaaagaaaacttctcgaggggcgtcattgtgcgtcaacaggatgaaagagtcgaaattgacatgtacatcattgtgggctacgggacaaaaatttccgaaatcgcccgcaacgtccagcagaaagtaaaatatacgctgaatcaaacagtcggcttatcagttgacgccattaatatttacgttcagggcgtgcgtgtcgcgaacccgtaacgaggaggaaattttgtggttacatcactggatggaaagcgttttgcagaaatggtcatacaaggggcgaaccatcttgcggcaaatgccaaaacggttgacgccctgaatgtattccctgtccctgatggcgatacgggaacaaatatgaatttaacgatgacttccggtgcaaaggaagtgcaaaaaaatgtccaggcgcatatcgggtccgttgccgcaagttttgcaaaagggctgctgatgggcgcgcggggcaattcgggcgtgattttatcccagctgttccgcggcttctccaaatcgattgaaacaaaagcgcatatttccgcaaaagagtttgcagcggcttttcaggccgggatcgagagcgcttttaaggcgatcatgaagccggttgaaggaacgattctcaccgttgcaagggaagcggccaaaaaaggcgtgcaaacggcgaaaaccgaaaaggatctggcggcagtcatggaagcgatcctcggggaagcgaaaacgacgctgagccggacgccggacatgttgccggtgttaaaagaagtcggcgtggtcgacagcggcggccaggggcttgtttttatttatgaaggctttcttgccgagttaaaaggggaagagctgccggatacaccgtccgtcatgccgtcaatggacgagctcgtaaacgccgaacaccataagcatgtgcaggactttatgcgtacggaagatatcaaatatgggtactgcacggaaatcatggtcaggctcgaccgctccaaaccgtccgccaagacattctcggaggagcggttccgcagtgatatgagccgtttcggggattccctcctggtcatttcggatgatgatatcgtgaaagtccatgtccacactgagcgcccgggtgatgttttgaactacggccagcaatacggcagcctcattaagttaaaagtggacaatatgcgcgagcagcacagcgcgatagtgggcgaaacgcatcatgcgcttgttggcgaaaacggagcggaacaggagaaaaaagaaaagaaagattacggtgtgattacggttgccatgggggacggaatcgctgcgctgtttaaaagcatcggcgccgatgttgtcattgaaggcggccagacgatgaacccgagcaccgaggacatattgaaagccattgaagaggcaaacgcaaaacaaatcatcattttaccgaacaataaaaatattgtcatggcaagcgagcaggcagcggaactagcggaagaaaaagtggctattgtcccgtctaaaaccgtgccgcagggaatggcggcgctgctcgcatttaaccccggacagccgtttgacaaaaacgtccaagcaatggaagaagcgctcggccgcgtgaaatccggccaggttaccaatgcggtcagggatacgaatattgacggcatctccatcaaaaaaggggattatatggggatttacgaagggaaaatcgtcaaaacgagtcctgccctgttggaagcatccgggcagctgctttcgcacatgatcggcgcggaagatgaaattgccaccgtcatatacggaaaagatgtcagcaaggaacaggtaaacgaactcgtttcctatattgaaaccaactggccggagatagaaatcgaagtccatgaaggcaggcagccgttatattcctttattttggcagtggaataagattgcttgcccgcatattataaaaagagcttgctgaatacgaaaaaatgcaccatccgctgctgtttgttttcatctgttgcagcgctttcaagtgcaaagctttcatccattcttttttggtaaaaaggttccagttcgggcgagccggccgaaccaacccggttttgcccggcaaactttaaaatcagcacaacggcgggtgcggcctgaaaaacggggcgcacccaccaagattgaaatcgcgaaaaaacacaataatgtgggtgtgatgcgcaatgaaatataaaagtgtttttgatattatcggcccggtgatgatcgggccctcgagctcccatacagcaggtgccgcgcgcatcggtcgggtggcgagaagcttattcggcaggcagccacagtgggcagacatccatttttacggatcgttcgcgaccacctataaaggtcacggcacagacgttgccattgtcggcggcctgctcgattttgacacggatgatgaacggatcaaatcttctcttcagattgcggaacagcacggactttcggtaaagtttttcgtggaaagcgccgtcacggatcacccgaacacggtaaagatccggatgggcgacgcatcgggagatatggaactgaccggtatctcaatcggcggcggaaaaattgaagtgacagaactgaacggctttgaactgcatttatccggccaccatccggctgtgctcgtcgttcaccaggatcgctacggggcgattgcggccgtatccaatattttatcagcacatgaaatcaatatcggccatatggaagtatcgcgcaaagaagccggaaagatggccttgatggctatcgaagtggaccagaatctcgatgacgccgtcattgaagagatgaagcagctcccgaatattacccaggttgcaagagttgtagattaatagtgagaaaaaagcgcagctgctaagcaggtggcgctttcttttggctgtctttaaaaaatgtgcgtgcatccttgcctgtgccaggagaagcagcatggatattgaaggagggaaattatgtttcggaatgttgctgagcttgtagaactggccgaacagcaaaataaaaaaatctcggaaattatgatagagcaagaaatggaagtaaccggaaaatcgagggaagccatcataaaaaagatggatgaaaatctggctgtgatggaaaaagcagttgaaaaagggattgccggcgtccactcccactcagggcttacgggcggcgatgccgtactgctgcaaaaatatattgaaaaaggcaatttcttatccggcgccaccattttggatgccgtcagcaaagccgttgcgacaaatgaagtgaacgcggcaatgggaacgatttgcgcaacgccgacagccggttctgccggcgtcgtgccgggaacgttctttgcggtcaaaaacaaactgcatccgacgcgtgaagaaatggtccgtttcttatttacagccggcgcattcggttttgtggtggccaataatgcgtttatttccggcgcagcaggcggctgccaggcagaagtcggatcagccgccgggatggctgccgcggctatcgttgagatggcgggcggcacaccggatcaatgtgcccatgcgatggccattacgttgaaaaatatgatcggcctcgtatgcgatcctgttgccggtcttgtggaagtaccatgcgtgaaacggaatgcaatgggggcggccaatgcaatggttgcggcagatatggcgcttgccggcattaaaagccggatcccttgcgatgaagtgattgatgcgatgtaccgcgtcgggcagcagatgccgactgcgctcaaagaaacagcgcggggaggcttggcggatacgccgaccgcccggaaactggaagccaaaattttcggtatgccgcttgatctgcatgaatagcccgcttgatctgccggtatccgttttaaaagggatcggtgaagaaacggaagcaagcctcgggcagatggggatttttaccatctatgacctgcttacttattttcctttccggtatgaagatgaccggctcaaagatttgcgtgaagtcgggcatgatgaacgggtgacggtgacggggagggtgcatagcgaaccctccctcatctattattcaaaaaaacggtcacgcctgtcgatgaaagtgttcgcaggcgattttctcattacggttgtctgttttaaccagccgtatttgaaaaagaaaatccatgtccatgatgagattacggttaccggaaaatgggacatgcaccggcatacgattacggcccaatccgtaaaaacaggcacggctgatcaaacgtccggattcgggcccgtctatgcggtgaaaggaaaaatgacggtaaaaacgttgcgcaaatacattcaatccgcctttcatgcttatggcagtgaaatcgaagaggcgctcccggcagaaatgcttgcaaaatataaattaatgccgaaaaagcaggccatgtttgcgatgcacttcccaaaatcggaacaagaagtgaaaatggcgagaaggaccattgtatacgaagagtttttggcttttcagctgaagatgcaggcgttaaggaaattcgagcgcgaacattcaaacggccgggccatccgctatgatgtgcggaaattaagacattttatcgactccttgccgttttcattgacggccgcccagaaaagagtggtaaacgaaatttgcgcggacatgaagtcgccgttccgcatgaaccgtttactccagggggatgtcggctccgggaagacggtcgttgctgcgattgcgctatacgctgcggtgacggcgggatttcaaggggcactgatggtcccgacggaaattctcgccgagcagcatgccgaatcgctttgccagctgctcgaaccgcacggcgtccaggtcgctttactgacgagcaccgtaaaagggaaacggcgaaaagcgcttttggaacagcttggaactggcggtatcgatattttaatcggcacgcatgctttaattcaggaagatgtggcattttcgcggctcggccttgtgatcacagatgaacagcaccggttcggggttgagcaaagacggatccttcgcgaaaaagggatgaatccggatgtgctttttatgacggcgacgcccattccgcggacgcttgccatcaccgtgttcggcgaaatggatgtttctgtcattgaccagatgccagctggccggaaaaagattgaaacgtactgggtgaaaaacaatctgttcgaaagggtgctcggctttatcgaaaaagagctcaaaaaaggcagacaggcgtatgtcatttgtccgctcatcgaggaatccgataagcttgacgtccagaacgcgattgatgtgtatgccattttaaaccaatattttaatggcaggtatacagccgggctgatgcatggcaggctgccgggtgacgaaaaggaagcagtcatgaaagcgttcagccgcaacgaaattcaggtgcttgtgtcgacaacggttgtcgaagtcggggtcaatgtgccgaatgcgaccattatggtcatttatgatgccgaacggttcggccttgcccagcttcaccagttgcgcggccgtgtcggcagaggcgatgcgcaatcgtattgtattttgctcgccgacccgaaaacagaaatcggcaaagagcggatgaaaattatgacggaaacggacaacggctttgttttgagcgaaaaagatctcgagcttcgcggacccggcgattttttcggaaaaaaacaaagcgggctgccggaatttaaagtggccgatatggtccatgatttccgggcgcttgaaacagccaggcaggatgcgcagcaattgatcagttccgatacattctggcatggcccggctttttcacacttgcggcgccagcttgaagcatcaggtgtgctcgaaggggagaaactggactaaagggagtttgcgttttgccagggcagctttggcaattcttgcaaacttccttttctttctatatactacgattagtaccaagtcctaaaatttcggatggtgtcacccatgaaaatgaaaaaaaaggaccggcagcaaagtttgcaggaaaccatcaggcagaatccttttattactgatgaagaactggcggaaaaataccatgtcagcgtgcagacgatccgccttgaccggctggagctttccattccggaactgcgggaaaggatcaaaaacgttgctgaaaagcggttcgccaatgaagtaagggcgctgccgatcgaagaagtcgtcggggaagtgatcgatatcgaattggatcgcagcgccatctctatttttgatgtcaaaaaagaacatgtttttaagcgaaacgccatcgcccgcgggcatcatctgtttgcgcaggccaactcgcttgccgttgccgtcattgatgatgaactggccctcacggcgaaagccaccatccggtttttgcggtccgcgaaaatcggcgaccgcgtcattgccaaggcaaaagtggcgaacgtcaatcaggaaaacggcagaacgactgtgtttgttgaaagctatgtcggccgtgacctcgtctttaaaggcgaatttgaaatgtatcgggatcatgccggaaaaggcggcagtgcttaactatgcttcgcggacaggtaaaccattttcccggggaccggcaaccccggttgcggcatggccgggaaaactttcgcacgggaaaagcttgattttagaaacggggctgaacagaatgaaattagcaattgatgcaatgggcggggattatgccccaaaagaaattgtacaagggattaaccgggctgtaaacgcatttccggacacggcgtttatcctgttcggggacgaaacgcaaatcaggaaggaactggaaacgtctgaccgcgttgccgttatccataccgatgaggtaatatctggaacagacgaaccggtgcgggcagttcgccgcaaaaaaaattcttccatggtgcgtatggcccaagccgtgaaagacggggaagcggacgcgtgcatctcggccggaaatacgggcgctctaatggcatccggtctctttgtggttggcaggattgaaggtattgaaaggccggcccttgccccggtgctcccgacaacggacgggcgcggttttgtcatgctcgatctcggcgcaaacgcggaagccaagccggaacatttgctgcagtttgccatcatgggctcgctgtatgccgaaaaggtaagaggcttaaaaaatccgcgcgtcggcctcttaaatatcggaacagaagaaaagaaaggcaatgaattaacaaaaaaagcatttcaacttttaaaagaaactgatttgaattttaccggcaatgttgaagcccgcgacttgctcgagggggcggcggatgtcgttgtcacagacgggtttaccggcaatatggtgctgaaaacgattgaaggtacggccggatccttgttttccatgatcaaaaaagtgttcatgcacaatctgaagacaaaactggccgctgcgatgatcaaatcagaactgtcaggcctgaaaaatatcatggactactcggaatacggcggatcgggtttaatggggctgaatgcgcccgtcattaaagcacacgggtcatcaaacgccaatgcaatttacaatgcggtgcggcaggcgcgtgaaatggtacagtctgacgtcaccggcaaaatcaaacacgcaattcaacaacttgaacaaaagtaaggatggaggaaaagagatggggaaaatagcatttgtttttccggggcagggatcccagacggttggcatggggcagtcggttgccggtgcaaatgaaaaagcggcggctgtttttcaaaaagcagatgaaaagcttgggatggacttatccgggctcattcaaaacggcccgctggacaaactgacccgtaccgaaaatgcccagccggcccttttaacggtaagcactgcgattttacaggtgcttcaggaagcgggcatccatgcagatttcacagccgggcacagccttggcgaatattcggcgcttgtggcagccggcgctttgtcttttgaagatgccgtatatgcggtacgcaaacgtggcgaatatatggatgaagcattcccgaacggtgccggggcaatgtccgccgtgctcgggcttgaccgcggcgtgctagaggaagttgcagatgaagtgagccgtgaaggggaaacggtccagctcgcgaatttgaactgtcccggccagatagtcatttccgggacagctgccggaattgagaaagcgggcgcccttgccaaggaaagaggggcgaaacgcgtcctcccgcttcaggtaagcgggcctttccactccaaattgatggagccggcagcggaaaaatataaggcggttcttgacgaaattgctatccgggatgcggcggttcctgtgatcgccaatgttgatgccgaagtggaaacgggcgctcaggacatcaaagcaaattgtatccgccagctctattcccctgttttatgggaagattctgtcaaaaaaatgatcagcctcggcgttgatacctttattgaagtcgggccgggcaaagtgctttccggattaatccggaaaattgaccgcagcgtaaaaacatatgccgtccaggatatggaaaccctggaagctgcggttggcgcgctgcaaaaataatggaggaggagaccgaatgcttttaaaagacaaagttgcgcttgtgaccggtgcgtcccgcggcatcggccacgaaatcgcgcttgcgtttgccgcttccggcgcgcatgttgtggtcaactatgcagggaatgctgaaaaagcggaagaagtggtaaacgccgtccgttcttatggtgtggaatcctttgccatccgggctgatgtttcgaatgaatcggaagtgcaggaaatgttcagacaggtgctggaaaaattcggcaaacttgatatattggtgaataacgccggcatcacccgggataaccttttgatgaggatgaaagaagcagaatgggatgcagtcatcgataccaatttaaaaggggtcttcctgtgcacaaaagcggcggcgcggccgatgatgaagcagcggagcggcaaaatcattaatattgcctcggttgtcggcatcagcggcaaccccggtcaggccaattataccgctgccaaagccggcgtcattgggcttacaaaaacggcggcgcgtgagctggcaagccgcggtattactgtaaacgccattgccccgggcatgattgaaacggatatgaccgataagctgacggaagacatcaaagaaggcatgctgggccaaatcccactttcccgtttcggcaagccggaagatgtggcaaagactgccctgtttttggcaagcagcagttccgactacatcaccgggcaaacgatccacgtcgatggcggaatggtcatgtaacggttgcggcaaagcttgtttttaagtttcactttattaattataaaaaatcctctataataccttgaggggaggtgaaccgcatggcagacgtattagagcgtgtgacaaagatcatcgttgaccgccttggtgtcgaagaatccaaagttacactggaagcgaaattcaaagaagatcttggcgctgattcccttgatgtagtggaattggtgatggaattggaagatgaattcggaatggaaatttctgacgaggatgctgagaaaattgtaacagtgggtgacgctgtaaattacatacaaaatcagcagtaatcgtcttcatgtaaaatgtcccgccccataaagcgggacatttttctctaatccggcgtcaatcgtctcctgcctgaggatggtaaatgggcaaaaaagcgcgatccctttttgcctatttacgaccgcccgggtcctgggagatgcctttgcgttcagcagtatttttctatatatttaagttaagttgaaactatatcaagatatcgggtggatgaacgatgggtaaaaaaataaaatcagatgaagaacatgtagtaaacaaattcggcaacctgcaggaacaactcgggatccattttcaagacgtaaacctgctgaaacaggcttttacgcattcctcctatgtgaacgagcatccggaaaagcgcaggcacgacaatgaaaggcttgaatttttaggcgacgccgtcctggaactgaccgtttcccattatttatttaatcggttcccgtcgatgaacgaaggggaaatgacgaaattgcgggcgtccgtcgtctgtgagccgtcgcttgtcatttttgccaatgagctgcatttcggcgagtatatcctgctcggtaaaggcgaggaaatgaccggcggcagaacgcgcccggctcttttagccgatgtgtttgaagcgtttatcggcgcgctttatttggacaaggggttaaaggctgttgtttccctccttgaaaaagtcgtattcccgaaaattgacgagggcctcttcagtagcacggcggattataaaagcaagttgcaggagtacgtccaaaagagaacttccggtgtgttggaatacacgattctcgatgaacgcggccctgcgcatgacaaggagttcatctccagcgtgtcgctaaacaataaagcgctcgggacaggaaaaggccgctccaaaaaagaagcggaacagcaggctgcgcaaacggctttatccaatttgcagaaagaagaaaaaaagaagccgtaaagaatggagggggaacggattgtttctgaaacgtctcgatgtgatcggatttaagtcatttgcggaccggatttcctttgaatttgttccgggcgtgacagcggttgtcggcccgaacggcagcggcaaaagcaatgtgatcgacgccgtccgctgggtgctcggtgaacaatcagcgaaaagcctgcgcggtggaaagatggaagatgttatttttgccggcagcgatacaagaaaaccactgaattttgcagaagtgacgttaacgcttgaaaacgaaggccgcgcccttccaattgattaccaggaagtgagcgtgacaaggcgggtgtaccgttcaggggaaagcgagttttatatcaataaacagcaatgccggttgaaggatattgtggaattgtttatggattccggccttggcaaagaagctttttccattatcagccaggggaaagtggaagaaattttaaacagcaaagcggaagaacgccgcagcatttttgaagaggcagccggcgttttaaaatataagacgcgcaagaaaaaggcggaagtgaagcttgccgaaacgcaggataacttaaaccgtgttagcgacattctgtatgaactggaaagccagcttgagccgttgaaaatgcaggcatcggtcgcaaaagattatctggaacaaaaggaagcattgaaaaattatgaaattgccgttttggcgtatgaaatagaatcattgcatggcgagtgggaatcgcttaaatcgcagcttgaagcacaccgggataaagaagcggggctctcttccgaaatccgcaaacaggaagcacagctggaagaaaagcgcaatcagctggacgcgctcgatgaatcgattcaagacttgcagaatgtgctgcttcaagcgacagaagagctggaaaaactcgaagggcaaaaagaagtgctgaaggaacgcaaaaagaacgccagcgagaacaaagcccagcttgagaaaaatataaatgaagcggagaacgctttaaaagaactggaagcccaaaaggaaaagcttttgcaaacggcggcggaaaatgaacaagccttatcgtccctgaaagaaagcgtgaaagagaaggaagcgggccttttccgcctcagcacgaatctggagggaaaaattgagtctttaaaaagcgactatattgaactgctgaatgagcaggcaagcggaaaaaatgaaaagcgcctgcttatgcagcagctgcaaacgtcgttaaaccgcctcagccggcttgaagccgacaaccggaaatatgtcgaagaacgggaaaaagtgcgggaaaagaaaaaaatggcgaccggccgccttgcaaaaatcaaacaggagctggaagcggcagccggtgcctatatggaaaagcaaaggcagctggaatccgtaaacagtcggtatcaaaaacaggagtccaatctgtatcaggcataccaatatttgcaaaaagcgaaatcacggaaagaaacgcttgaagagatggaagaagattataccggcttttaccaaggcgtgcgtgcaattttgaaagcccgcggcaaacagctggaaggcattgaaggtgctgtggctgaactggtccgggtgcccgcgccttacgaaaaagcggttgaaacagcactgggtgcttcgatgcagcatattgtgacagaaacggaacggcatgcgcggcacgccattgcatttttaaaagaacgaaaggccgggcgggcgacttttttgccgctcgatattattaagccgcgggccattccggaagcaagcctcaaaccgctccgcaatgaagaggcgtacgtcggcgtgtgcgcggagcttgtccgctttgaaagccgctaccagtccattgtgtccaatctgctcggccatgtccttgtagtccgtgatttaaaaagtgcaaacaaaatcgccaaaatgctcggctaccgctaccgcatcgtgacgcttgacggggatgttgttaatccgggcggctcgatgacaggcggggcttcgaaacaaaacagtgtgtcactcctttcgagaaaaagcgaactggaagcattaaaagaaaagcttgccggcatggaaaaaacaacgatggcgcttgaaacggaagtcaaagcattgaaagccgaagcttcccgcatgcaacaggagctggatgaagcgaggaaaaacggcgaagcgctgagacttggagaacagcaggcgaaagcggaactggaacggcttgcggttgaggaaaaaaatctggatgagcacctgctcgtctacgatatggaaaaacaagaggcggaaaagcagcaggatgaagcccgtaaacggatcggcgaactggaagatatgctggcgcgtaccggcgaaaaagcgcagcaactggaagcggaaattgaagccctgaccgtaaagaaaaacgatgattcgacggcaaaaagcaggctccagggcgaactgagcgatttaaaatcgacgcttgccgtaaagatggaacaggcggcgcgcgaccgcgaagagcttgcgcggctcgaccgtgaaataaaggagtgggcgtcacgtaaagcgcgttacgatgagcagtaccactttcttacggacgaatcgaagaagcatcacatgtcggaaagcgaactggcagaagcggccgaacaaaaagcgcgtgacaaaaacgatacgctcgcctttatcgccgtgcgcagggaagaacgggcccggctgacagcagagatggaagacctggaacgcggcctgaaggaatggaaacggcagcaaaaagggctccagcaggccattcaggatgaagaagtcaaagcaaaccggctggatgtggaacttgagaaccggcttcaaaggctccgcgaagaatacacgctcacctttgaagccgcgaaagaagcccgcccgctcaatgtttccctggaggaagcacgcaaaaaagtgaagctgatcaaactgtcgattgatgagcttggcgccgtcaatctcggcgcgatcgaagaatatgagcgcgtatcggaacgttaccagtttttaaaagaacaggagaccgacctgcttgaagcaaaagacacccttgaccaggtgattacggaaatggacggcgaaatggtccgccggttcgatgagacgtttaacgccatccggaacgaattcgaacccgttttccgcgagctttttggcggtgggagagcggatttgcggctgacggatccgaaagatttgcttacgacaggcgtggaaattttcgcgcagccgccggggaaaaaactgcaaaatctcgggctgctttcaggcggcgaaagagcgctgaccgcgatcgcgcttttgtttgcgattttgcgtgtgcgcccggtgccgttttgcattctcgatgaagtggaagctgcgctggatgaagccaatgtataccggtttagcaaatatttgaaacaattcagtgcggaaacccagtttattgtcatcacccaccggaaaggaacgatggaggaagcggacgtcctctacggggttacgatgcaggaatccggcgtatcgaagcttgtgtcggtcaaactggaagaatcaaccgacctcgcttttcaaacgtcttaaacaggcgaatcagcgccgtgtttaaaaagaagcgcccgtgccacaagcgggccggcagggataaaaatcaggccggcgatttttacgactgctcgtgcggcttttatgccgcacaagctgatacgcaaattcaggaaagccaaaggaagtggacaaatgagcttttttaaaacattaaaagacaaattcacccggcaagccgatacggtaaccgataaatttaaaaccgggcttgcaaaaacgcgcgataatttctcgaacaaagtcaacaatcttgtcgcgcgttaccggaaaatcgatgaagactttttcgaagaactggaagaaattttaattcaggcggatgtcggcttccagaccgtgatggaactaatcgatgaattaaaaatggaagtgaaacggaaaaacattaaagacccttctgaagtccagtccgtgatttccgaaaaactggttgacatttattcggccggcgaagatgccccgaaccggcttaacatccaggacggcgccttgaccgttattttgtttgtcggcgtaaatggcgtcggcaaaacgactacgatcggtaagctcgcccatatgctgaagcagcaggggaaaaaagtgatcatggcagccggcgatacattccgcgccggcgcgattgaacagcttgaagtctggggagagagggtcggcgtggaagtgatcaaacattcggaaggatccgatccagccgctgtcatgtttgacgccgtccaggcagcgaaagcaagaaatgcagatgtgctgctttgtgatacggcgggccgcctgcaaaacaaggtcaatttgatgaaggaactggaaaaagtaaagcgtgtcatcgaacgggaaatcccgggcgccccgcatgaagtgctgctcgttttggatgccaccaccgggcaaaatgcgatggtgcaggctaagacgtttaaagaagcaacagacgtaaccgggattgtgctgacaaaattggatggcacggcaaaaggcgggattgtgctcgcgatccggaacgaactccatattcccgtcaaattcgtcggcctcggcgagaaaatggatgaccttcagccgtttgatgcggaaaaatatgtgtacgggttgttttccgatctgatcgatgaagtgccggaagaacaagcctgaccgtatgtgggccgtactgcgaatcagaaggccgcggtattaaagcccgccgggagcgcttcaaatcggttgtggggaaacgaacttgttttcattgacaaaaaacaggaatctttgtattctgtgtttatgtaaagcattttcacttaacagggggaagaagccatgctggagaaaacaacgcgaatgaatgatttgtacgatttttaccaatcgttgttgactccgaagcagcgcagctatatgtccctctattatctcgacgacttatcgcttggcgaaatcgccgaacaatacggtgtgagtcgtcaagcggtttacgataatatcaaacgcaccgaacaaacgcttgaagactatgaaaaaaagcttggtttattggaaaaatttcaagcgcgcacacgcattttccggtcgatgcgcaatcttttggcgcatgatgccaatccggaactgttgcggcttgtcgatgcgctcgaaaaattggaatagggggcggaaaaatggcatttgaaggactcgcagaacgcctgcagggcacgatgcagaaaatccgcggaaaaggcaaggtcacggaaagcgacgtcaaagaaatgatgcgggaagtccgtcttgcccttctggaagctgacgtcaatttcaaagtggtaaaagattttgtaaaaaaagtgagcgaacgtgcggttggccaggatgtgctgaaaagcctgacgcccgggcagcaggtcatcaaaattgtccaggaagagctgaccaaccttatgggcggatcacagagcaagattgccgttgcaaagcgcccgccaaccgtcatcatgatggttggcctgcagggtgccgggaaaacgacgacatccgggaaactggccaacctgttgcgaaaaaaatacaaccggaccccgctgctcgttgcggccgatatttaccgccccgctgcaatcaagcagctggaaacgctcggcaaacaactcggcatgccggtgttttcgcttggcgacaaaatcagcccggtggaaattgccaggcaagcgattgaaaaagcaaaagaagaacatcacgataccgtcatcatcgatacggccggccgcctccatattgacagcgagctgatgaatgaactgaaggaaatcaaggaacttgcgcatccggatgaaatttttcttgtcgtcgatgcgatgacaggccaggatgccgtaaatgtcgcacaaagttttaatgaccagctcggcatcactggcgtcatcctgacgaagcttgacggcgacacgcgcggcggggcggctttatcgatccgggccgtaaccgaaaagccgattaaatttgccgggatgggcgagaaaatggatgcgctcgaaccgtttcacccggaaaggatggcctcccgtattctcggcatgggcgatattctgtcgctgattgaaaaagcacaggaaactgtcgacgaagaaaaagcgcgcgcgctcgaaaagaaaatgcgggaccagtcatttacgctcgatgatttccttgaacagctcggccaggtccggaaaatggggccgctcggcgacattttgaaaatgatcccgggggccaaccggatgaaagggatggataatctgcaaattgatgagaaacaaattgcgcatgttgaagcgattatccagtcgatgacaaagcaggaaaaaatccgcccggacatcatcaatgcaagccggaaaaaacggattgcgaaaggttccggccgcccggtacaggaagtcaaccggcttttgaaacagtttgaagaaatgaagaaaatgatgaaacaactgcagggcatgaatcaaaaaggccggaaaaaaggctttaaattcccttttatgtaaaaaacgagggtgttaagagaaaagactttacaccatcatgattttctgatatgatacagtcttgtgagaaacttttttggaggtgtatgattaaaatggcagtaaaaatccgcttgaaacgcatgggtgcaaaaaaatccccgttttaccgcattgttgtggcagattcccgttcaccgcgtgatggacgttttattgaaacagtaggaacttacaatcctgttgcagatcctgcagaagtaaaaatcaacgaggaagccgcgctccaatggctgaaaaacggcgcccaaccgtctgatacggtacgtaacttgttttcaaaacaaggtattatggaaaaataccataacgaaaaacacggcaaataatcatggaccaacagatggatgatttaatcctttcgatcgtcaggccgattgtcagccatccgaatgaagtgcgggtagaacgggatgaacaagaatccggaacgctctaccgcctgattgtccatccggatgatgccggcatggtcattggtaaaaaggggcgtaccgcaaaggccatccgtacggtcgtttatgcggcagccggcgtgcacggacataaaaaaatccgtcttgaaattgccgaataatggacaacgatggatagaacaccagtgaaagggaggggcacacctcccttttttatacatctttcgggctttccccctcatcttaaccgacatccgctttttccggctgcattttttgggttttttattgaatggcgcgaaaaggagggcagggcattttgaaaatccttcaaaaagtgacggtcaagcaaatcctgaccgaaaagagcaaaggaatgcttttggatacataccggcaaaagaaacaacaacttcaaaaagagtgtgagcagctccggtttgaaacaaaaaaactggaaaagcaaaaaaagttttcgggaaccaatttaaaaatgcattttgaaaaagaaattgaaagccggcaggagaaaatcaaactggtggagttccaaattgaacaactgcttttgcttccgatcgggacagaattaaaagaaaaagaaattcacgccattgttgacgtccgggaaggcgacgattggaatgcggtgacaaaagagaaatcgattattataaaagatggcatcatccatgaaattcgcgagaggtgagcatatgacacaatggtttaatgtcggcaaaatcgttaatacacacggcatccgcggagaagtgcgggtaatttcccaaacggatttcaaagcggagcgctataaaccgggcaatacgctttacttgttccttcccggccgcgatgagccgcttgctgttacgattgaatcgcaccgggtgcataagcagtttgatttgctgaagtttgagggcttcgattcgattgaggaagccgagaaatggaaaggcggcatgttgaaagtttccgaagaacagttggatgagcttggcgaaaatgagttttattttcatgaaatcatcggctgtgaagtcgtgacaaccgcaggcgagaaagtcgggacggtaaaagagattttaacgcccggggcaaatgacgtctgggtggtgaaaacagcgcagcagaaagaagcgctgatcccgtatattgaagacgtcgtcaaaaaagtcgacaaaaaagaaaaaagaattgtgattgaaccgatggaagggcttttgccatgaaaatagatatattgacgctgttcccggaaatgtttgaaggcgttctcggatcctccattttaaaaaaagcagaagaaaaagggatcgtccattatcatctggtcaatttccgtgaatacagcgacaacaagcataaaaccgtcgatgactacccgtacggcggcggggcgggcatggtgttaaagccccagccggtgttcgatgctatcgaagaccggcttgaggggagcgaaaaaaagccgcgcatcattttgctctgcccccagggggaaacgtatacgcaacaaaaagcggaagcgtttgcggaagaagaacatctgatctttatttgcggccattacgaagggtatgatgaacggatccggacgcttgtaaccgatgaaatctcaatcggagactatgtgttaacgggcggcgagctgggcgcaatggtcatgatcgacagcatcgtccgcctgcttcccggtgttttgggcaatgaaacctcgcctgttactgattctttttcgaccggactgctggaacatccgcattatacgcggccggcggattttcgcggaatgaaggtgccggacgtgttattatccggaaatcaccggctgattgaagaatggcgcgaaaaagagtcgctgtaccgcacctatacgagaaggccggatcttttacgcggatatccgctctccgaaaagcaaaaagcgtggctgaaagaatgggaagaaaaacgcggatagctgttgcaatcagcatgcgtttatgctaagattgcttttgtggtttgcttgaaaacaaggcagaccgccgtaaaacgatgttccgctgcaaatacgatggaagatttgcaagagcatttgttggaaggagttgaatacgatgcacaatattattgacgaaattacaaaagatcaacttcgcactgatctgcctgctttccgcccgggggatacggtccgcgtccatgtaaaagttatcgaaggttcacgcgaacgtatccaggtttttgaaggtgtggtcattaaacgccgcggcggcgggatcagcgaaacgtttacagtccggaaagtttcttacggtgtcggcgttgaacgtacattcccgctccatacaccaaaaattgcgaagcttgaagtcgtgcgtcgcggtaaagttcgccgtgcgaaactttactacctgcgtaatctgcgcggtaaagctgcccgtattaaagaaattcgctaatttgctgcaacggctgttcgaaaaggggctatcatggccccttttcttcatacttatacataaataacccgggtgtctctgaggttttcaatcggcaaccaatcctgttataatgcaaaatatcagggaatatacgcttatggatacatggaatgaggcggtgtaaataaatggcaaaacagaaaaaaccaaaaaatgaactgttcgaatgggtgaaagcgctgctgattgctgtggcactggccggcattttgcgctactttttcttcgccccgatcgtggtcgacggctcttccatgatgccgactttgaaaaacggcgaccggatgattgtgaataaaatcgggagcccgaaacggttcgacatcatcgttttccacgccccggaaggcaaagattatatcaaaagggtcatcgggctgccgggcgaccggatcgagtataaaaatgacatcctgtatattaacgggaaagcgtataaagagccttatctcgataaatataaaaaagccgtagccgacggaccgcttacggaagattttaccttaaaagactatatcgggcgcgacacggtgccaaaagggcagatttttgtgatgggcgataaccgccggtacagcaaagacagccgccagatcgggacgattccgctcagcaaggtggtcggggagacaaactttgtatactggccggtgaaagatgcccatatgatcaataaataagcgcccgttcgttgcgcattttacggaaaaaagtaaccgttatggagttgacgcatgatggcaatacaatggtttccgggccatatggcgaaggcaaggagagaagtgaccgaaaaattaaaactggtcgatattgtttttgaattgcttgatgcaaggatcccggtttcctccgccaatccgatgctggatgaactgattcagcaaaagccgcggatcaaattgctgaacaaggccgatatggcagatccggccgctacagcccgctggcttgaaaaattgtccggcggcaatacgcatgtccttgccattgacgcgcaaagcggaaaagggctcgacaaaatggtgaaactggctgaacagattttggagccaaaatgggagaggatgcgggcaaaaggcatccggccgcgtgcgatccgggccatgattgtcggaattccgaacgtcggtaaatcgacgctcattaaccggcttgccgggaaaaatatcgccaaaaccggcaatacgccgggcgtgacaaaagcgcaggcatggataaaagtcgggaaaacgatggagctcctcgatacgcctgggatcctttggccgaaattcgaagacaaagaaaccggttataagctcgctttaaccggtgcgattaaagacacgatcctcaacctgcaggacgtttccgtatttggcctgcgttttcttgaaaaacattatcccggcacattaaaagcccggtacaagcttgaggatatcccggatattgtccccctttttgaccatatcggtcgcctgcgcggctgcttgcgggcgggaggggaaatcgattacgacaaaacggctgaagtgattatccgtgatatccgcggcatgaaactggggcctctgacatttgatttgtaataagcgctctccgtaagggagtgcttatttttcggggaggggaaacattgaaaatcagtgaaattgaagcgcgtcttcaggaaatcacaaacccgtccgatccgtttatccaggcgctaggccgggacgaacggaaaggcgcacaaaaagcgctggaaaaatggatgagaaaattacaaaaagagcgtgaacagcttgaaaaattccgggagatgggacggtttgaagacgccctgcgcagccacggctgccgcctgatcgccggaattgacgaggcaggcagggggccgcttgccgggccagttgtagccgctgccgtcattcttccagaagatttttacctgcccggcctgaacgattccaaacagctttccgaaaaacagcgggaggccttttttgcgcggatccaggaagaaacccttgtcggcgtcggctttgccagcgcagaagaaattgacaggatgaatatttacgaggcggccaaaaaggcgatgcttgcggctttgggccatttgcctgctgctcctgaccatttgctgatcgatgcgatggaaattcccgcttcgtacccgcaaacttcgattgtaaaaggggatgcgaaaagcatttcaattgccgcggcatctgtggttgcaaaagtaacgagagaccggtatatgcaggaaatggatgaaaaatatcccggttacggtttcgccatacataaggggtacgggacgaaaaaacatctggaagcgctcatgaagcttggcccgtgcccgatccatcgaaaatcgtttgcgccgattaaagacagaccggcaatccgccgataaataagcaagaagaaagaaacagggcgggggaatagcatgcaaatttttttaggcaaacagccattttctattgatgccggctcaaatatccgcacgtttgcatttcaaacggggcagattttttccggtgccatccaaaaactgtttccaaatgacaccgcacttgtccaggcaggcgggcgtacatttgccgcgaaactcgaagtgccgcttgaagccggaaaaaactactggtttcaaacggttttggccgacggtgaagtgcagttgaaaatgctttcggaagccgatgcaaacggcatggccgggaaagctttgctcccgcaaatgcaactgccgccaggaaaaacgttccagtcccttgtttcgtacttggctgaacaggaaattccgtttacgaaaaatgacattgctgcgatcggcgcatggctgaagcatgtaccggatctggcaaacgggctggaaacggctgcctttatgctccaagaaggctttcctgtgtcagagggcgtgttcacttcgctccttgccgcaggtcaaaacataccggcggatcagcttttaaaccggttgcagcaggcgctcaagcagggggaacagacgccggaaacgaggcaattgcttgcacttatcggggagcttgggacaggcagcgagcaggtgacaggagaggcgttacgccggcaaatcaaagagaagattcaaaaaatgggacttttttatgaggcggggcttttgcatgaggacaaagccgcggacaaggacgggctgcctttaaaagcgctgcttgttgatttgctgcaaaaaggcgggggaacaaaagctgcccgggatgcagcagacgaaatcgtacagaaactgaacggccagcagctgctcgcgctttccggcggggtagtgcagcacatttggatggaaattccgctttcattcgcgcactttcaaacgaatgccgttgtacaatggtcaggcaggcggaaaaatggcggaaaaatagacagtaattattgtaaaatcattttttacttgaatcttcagtttatgaaagaaacattggtcgagatgaatgtgcaaaaccggatcgtttccatccgcatttccagtttgaaaaagggtcttcaggaagccgtgaagccttttttgccggctttaaaggaaggcctttccaaaaccggttacacattgtctgacgttcggttcggggaattccagccggatgctgtgcgtgccacgctcagccggccggaggtttccgggaaaggggttgatcttaggatatgaaggatccacaaaaggacataaaagaagcggtcgcgctccagtacagcccggatgcgcattccgcccctgtcgtgaaggcaaaaggtaaaggggatgtggccaggcggattattgaagaagcaaaaaaagcgaatgttccgatccagcaggacccggatcttgccgcactgctcggccggcttgacatcaacgaagcgatcccggaagaactgtatgcagctgtggccgaggtgtttgccatgatttaccgcctcgaccagtcgctaaaaaacaaggataaaaaatgaacgaaagctgaccattaagcctgggcacccatttgcataaaggctgcggtgacaataggccaacgaccagtaaaatcacgtccattttataccgaaaaaaatattcttgaataataatagccattttagttcattatggtagacatcttttccgatgtttattaaaatgaaagcgcagttaattttttgaacagtttgataggaggatggaacatgaatattcacgagtatcagggcaaagagatcctgagaaaatacggggtcgctgtgccgaacgggaaagtggccttcaccgtggatgaagcggtggaagcagcgaaatcgctcggtacacaagtatgtgtggtaaaagcgcaaattcatgccggcggccgcggaaaagcaggcggcgtcaaagtggcaaaaaatttggatgaggttcgtacatacgcacaggaactgcttggcaaaacgcttgtgacgcatcagacaggccctgaaggaaaagaagtgaagcgcctcttgatcgaagaagggtgcgacattcaaaaagaatactatgtcggccttgttttggaccgtgccacaagccgggttgtgctgatggcttctgaagaaggcggcacggaaattgaagaagtggcggcgaaaacaccggaaaagatttttaaagaaaccattgacccggcagtcgggctcttgccattccaggcgcgccgcattgcgttcaacatcaatattcctgctaaacttgtaaatcaggccgttaaatttatgacaggcctttatcaagtatttgtggaaaaagactgctcgatcgcggaaatcaatccgcttgttgtaaccggcgacggaaaagtaatggcgctcgatgccaaattgaattttgattcgaacggcttgttccgccagcaggatgttctggcgtaccgcgatctcgaagaagaagatccgaaagaaattgaagcgtcgaaatacgatttgagctatgtcgcccttgacggcaatatcggctgcatggtaaacggcgccggccttgcgatggcgacaatggacattattaaatattacggcggcgatccggccaacttccttgatgtcgggggtggcgcaacggaagaaaaagtaacggaagcgtttaaaatcattttatcggatgaaaaagtcaaaggcatttttgtcaacattttcggcggcattatgaagtgcgatgtcattgcttccggcgtcgttgcagccacaaaacaagtcggactcgacatcccgctcgttgtccgtcttgaagggaccaatgtggaacttgggaagaaaattttaaacgaatctgggctgaaaattgttgccgctgaatcgatggcagacggcgcgcaaaaaattgtcgaactggtcagctgacagcagctgttcattcagacaaaatgcgaacaaatattcttgaatgaagaaggcaggggaaaaaagtgagcatttatgtaaataaagacacgaaagtcattgtccaggggattaccgggaaaacggcgcttttccatacaaaacaatgcttggaatacgggacgaaaattgtcggcggcacaagccctggcaaaggcgggactgaagtagaaggcgtgccggtctttaatacggtgaaagaagccgttgaaaaaacgggcgcaaccgtttcagttatctatgtgccggctccgtttgcggcagatgcgattatggaagcggtcgatgcagaactcgatcttgtcatctgtattacggagcatatcccggtattggatatggtcaaagtgaaacgttatatggaaggaaagaaaacgcgcctgatcgggccgaactgcccgggcatcatcacgccagacgaatgcaaaatcggcattatgccgggttatattcataaaaaaggccatgtcggcgttgtttcccgttccggtacgctgacttatgaagccgtccatcagctgacgcgcgctggcatcggtcagacaggggcgatcggcatcggcggcgaccctgtgaacggaaccaattttattgatgtattaaaagaatttaacaatgatccggaaacggaagcggtcattatgatcggtgaaatcggcgggacggcggaagaagaagccgccaaatgggtgcaggcaaacatgaagaaaccggttgtcggttttatcggcggtgtcacagcgcctcctggaaaacggatgggccacgccggcgccatcatttcaggcggcaaaggaaccgcagccgaaaaaatccgcacgatgaacgaatgcggcatccaggtggccgaaacaccggctgtcattggggaaacgctggttcgtgtgctgaaggaaagaggcctttacgagaaatgtaaaaacctttaagcggcggcaccggccgtcccggaacccgcattttccgggacagcccggtgaaactgcccggatccggctgccatttttaagcgtgcagccgggtcctaaatgtttttctttttcaatggaatacggtctgaaagcgaggcaaacaatggaaccattaaaaatcaaatacattcatttggatcattgcaggggaatttcccgcgtgcaaaaaatgaaaatcctcgaatttgatccgctgcttgaaaaaatctgccggattccccctgaaacactgcgcgccatgcttcatatgcaaaaggaaacatttgaacgcttttatgaagatcttctccatcttgacatcaaaccctatttaaccctctaccagaaaaaacagatccgaatgacagcccgttttgaaccggaatatccgccgcttctgaaagaaacgtaccagcctcctgccgtactctattcaatcggaaatgtatcattgctgaaaaaccgtgcgctggccgttgtcgggtcaagaaaggccggttcctatgcagaaaaagtcgccgatcatttgctgccacccctgatcgaaaaacagtttgccattgtcagcgggctggcgagaggggcggattcgattgcccaccgtgccgccatgaaatacggggggaagacgattgcggtgctcggaagtgggttttttcatatttatccgcgggaaaatatacaaatggcggaaaaaataaaacagggccatttactgctgtcggaatatccgccgtttacgcgcccggaaaaatggcgttttccggaacgcaaccggatcatcagcggcatttctgaaggtgtgctcgtgcttcaggcggaaaaacggagcggctccctgatcacggcagattacgccctccaggaaggccgggaagttttcagcgtgccgggaaacgtgctggacagcctgtcgaaaggaacaaaccatcttatccagcagggcgcaaaattggtaacatgcagcggagacattttggaagaactgcttccgacaaggtaaaaaatagttagagaaaattcataaatgggcagtgattttccgattttgtgaaaaaacgcatgatttttggataaaatggttataaaatagagaaagaaaagataaaattttcaaaatgaaaccgcttgcgatgttgatttttcatcattcgtgctgttacaattgacaaatgcgggcatccatgcccataattacaaatgattttgtttgaaaaatgaaagcaaagttgctgcaaagagagggtataagctctccagggaggatttttgaatgtcagactacttagtgattgtagaatcacctgcaaaagcgaaaacgattgaaaaatatttgggaaaaaaatatagagtgaaagcttccatggggcatgtgcgcgacttgccgaaaagccaaatgggggtggatgtggacgaccattttaagccgaagtacattacaatcaggggcaaggggccggtcttaaaagatttgaaaaacgcggccaaaaaagcaaaaaaagtctatcttgccgccgaccctgaccgcgaaggggaagcaattgcctggcatctcgccaacagcttgaatctggatgtgcattcggactgccgcgtcgtgtttaatgaaattacaaaggacgcgattaaagaatcatttaaacatccgcgcccgatcaatatggaccttgtcgatgcccagcaggcaagacggattttggatcgtctcgtcggttataacattagcccgcttttatggaagaaagtgaaaaaaggtttgagtgcgggtagggtacagtccgttgccgtccgccttatcatcgaccgggaaaatgaaattaaatcgtttgtgccggaagagtactggacgattgccgggtcctttaaaaaagggaaagacacgttccaggcatctttttacggtgtggacgggaaaaaaatgcagctgaagtcagaagcggatgtgaaaaaaattaccggcatgctgaaaagcgacaagttccaggtttcttccgtcatgcacaaagagaagaaacggaatccggcaccgccgtttacgacttcttccttgcaacaagaagccgcccggaagctgaacttcagggcaaagaaaacaatgatggtggcccagcagctgtatgaaggcatcgaccttggaaaagaagggactatcgggctgatcacgtatatgagaacagactcgacccggatttcggaagtcgcaaaaacagaagccaatcaatatattcgggaaaaattcggggaaaactatttgcgccaggaagaaagaaaagagaaaaaacagacaaatgcccaggatgcacacgaagggatccggccaacaagcattttccgggatccgggttcggtcaagtcctttctaagcagagaccagtataagctgtacaaattgatttgggaacgctttatggcaagccagatggcccctgcgatactggatacgatgagtgccacgctggcaaacggcacggttttgttccgggcgtccgggtcaaaaatccagtttccgggttttatgaaagtgtatgtggaaggttccgacgaccagcaggaagaaggcgaacgttatttgccgcatctcgaagaaggggatgttgtccaatctgagtcgatcgaaccgaaacagcatttcacccagccgccgccacgctataccgaagcccggcttgtcaaaacgctggaagaacttggaattgggcggccgtccacctatgcgccgacattggatacaatccaaaagcgcggctatgtggcgcttgagaataagcggtttgtcccgacagagctcggcgaaatcgtgctcgaattgattcgggaatttttcccggaaatcatagatgtcgaattcaccgctgatatggaaaaagacctggacgaaattgaagaaggaaaagtaccatgggtccaaatcattgatgcgttttatcaaaattttgaagcccgcctgaaaaaagcggaaaccgaaatggaaaaaatcgaaatcaaagatgaagaaaccggggaaatgtgcgagctgtgcggaagtccgatggtgtataaaatggggcgttatggcaagtttatggcttgcagcaattttcctgattgccgcaatacgaagccaatcgtcaaaaaaatcggcgtcacttgcccgaaatgtggtaaaggtgaaatcattgagcggaaaacaaagaaaaaccgcattttttacgggtgcgaccgttatccggaatgtgattttgtctcttgggataagccggttggcaggaagtgcccgaagtgcggcgacatgctcgttgagaaaaagctgaaaaaagggacgcagatccaatgtgtgcactgtgactataaagagcagtcggtgaagtaatgatcgaccttgctggaactttggcggccttgcgtggagcgggcggcaaagttccggttgatcaaaatgaatatttacatttttacgagaaaatgcatcttattcttttacttcttggagcagctgttgtaaaatgcttaaaggacagttgcgacaaaaaacgacagaattcccgaatcgttggcgggcagcggccaaaagcttttcaataaatggcattcctggcttttcacggcaggaagcgccagtcaaaaggacaattcgaaaatttatgaaaaatatgtaacattcgttgcaatccgatccggaaatgtgttatgatttaaccggatttccgaatgccgtcccttggcttcgaagcatatgagccggcgggagacggggtttcggttggcgcaagccggggcttacggatacccggaccggcgcaaaaagcccggctggcgggtttgtccgggccgttttaccggctgaaaaaaatggcaataactccggaaagcctattgttgtctatcaacgtgaaaagtggcgtaaagcaagcccgtttccccgccatgtgaggtgttaaacagatgaacggcgaactgtccggctatttgctttcttttatggaatacatgcaagtggagaaaaactattccgcatacacaatcaaattttatcgcctggacctggagaatttttttgcgtttttaaccgcacaggggattgcctcgctggacgaggtggggtatccggcagggagactgtatttgacaatgttgcatgaacacggatacagccgcgccacggtagcacggaaaatatccagcattcgcagtttttttaaattcctgatgcgggagagaatcgtcaaagaaaatccctttgcacttttatcacagccgaaacaacataagcgcctgcccaaatttttttatgaggaagaaatggagcaactgtttgcggcatgtgaaggcgatgatgcactatcccggcgcaaccgtgctttgctcgaaatcctgtatgcgaccggcatccgcgtgagcgaatgcgtcaatattcggttgcaggatattgattttgaattcgagacgatccatgtaaaagggaaaggaaaaaaagaacggatcgtgctgttcggccattttgcaggggaagccgtttcggattatatggcgcatgcacggaaaacgttgatgcgcggtaaagaagaccatccctatttatttgtaaatgcacgcggcggcgcattgaccgataaaggtgtccgctatattttaaatgaaatgatcaaaaaagcggcactgaccggaaaaattcatccacacatgttgcggcatacatttgcaacccatttgctgaaccatggggctgatttgcgcacagtacaggaccttcttgggcatgaaagcttgtcttccacgcaagtctacacacatgtaaccaaggagcatttgcggcaaacttatatggcttaccacccgagagcatagcaatgcaaggcggttcgctttgattacataggaggtgctgatatgggtgattttcacgcaaccacaatattcgccatccgccataacggaaaaagtgcaatggctggggatgggcaggtgacgctcggaaactctgtcgtgatgaaaaatacggccaaaaaagtccgccggctgtttaacggaaaagtgctggccggttttgccggctcggttgcggatgcttttacgctttccgaaatgtttgaaggaaaactgcaggaatataacggcaacctgacgcgggcagcagtggaactggccaaaatgtggagaagcgataaagtgctccgaaagctcgaagcgatgctgattgtcatggatgaaaacaatttgctgcttgtctcgggaacgggggaagtcattgaaccggatgacggcatcctcgctatcggctcgggcggcaattacgcgctcgctgccggccgtgcactgaaacggcatgcggcagagaacttcaccgcaaaagaaattgcgcgggcttcccttgaaatcgcatctgaaatttgtgtatttacaaattcaaacattatcgtggaagaactataagcggaaaggttcccgtaccggtatatttccataaaggagtgagcggattggccaacacgtttagaaaaacaaacagtttgacaccaaggcagattgttgagcgcctggaccagtatattgtcggccagaaagaagcaaagcgggctgttgccgtggcgctcaggaaccgttacagaagaagcctactgtctgaaaaaatgcgggaagaaattattccgaaaaacattttgatgatcgggccgaccggtgtcggaaagacggaaatcgcaagaagaatggcacggcttgtcggtgccccgttcgtcaaagtagaagccacgaagtttacggaagtcggatatgtcggccgggatgtggagtcgatggtacgcgaccttgtcgagacggctgtccggcttgtaaaagaggaaaaaatgaacggcgtgcgcgatcaggcggagaaaaatgcaaatgaacgcctcgtcgatttgcttgtcccgtcgcggaagaagcaagggaatttcaaaaacccgtttgaaatgatttttggcggcggcgggcagcaggacacggcaccggatgaagaggaggaagaatactccaaaagggaacagaaacagcgtatacgggaaaagctcttaaacggtgaactggaagatgaaccggttaccgtggaagtggaagagcaggcttcgtccatgtttgatttgttccagggttccggcatggaacaaatgggcatgagtgtgcaggacgcgcttggcaatctgctaccgaaaaaaacaaaacggcggaaattgccggtcagggaagcaagaaaagtgcttgcacaggatgaggcacagaaactgatcgacatggacgaagtgacccaggaagccattttccgggcagaacaaaccggcattatcttcattgacgaaattgacaaaattgcctccaaaaacgggaacgggtcccaagcggacgtatcgagggaaggcgtccagcgggatattctgccgattgtcgaaggatcgacggttgtcacaaaatacggctccattaaaacggattatattttgtttattgctgccggcgcttttcatatggcaaaaccgtccgatctgatccccgaactgcaagggcgtttcccgatcagagtggagcttgagaaactgaccgtcagcgattttgtcaaaattcttgtcgagccggataatgccctggtaaaacaatatattgcattattggaaacagaaggtatacaaatagaattttctgacgaagctattaccagaattgctgaaattgcttttgaagtgaaccaaaataccgataatatcggggcgagaagacttcataccatcatggaaaaactgcttgaagatctgtctttcgaagcaccggacatccatttggaaaaagtgtccatcaccccgcagtatgtggacgaaaagctcggtgcgatttcacagaacaaagatttaagccagtatattttataaccgttttgaaaaatcggataagggtagacgtgtaatgaaggctttctctcttttgcggcaggtcccggcaattcaatgcagttcaaataccgaatcaatctaggaggaatggaaatgagtttgttagataaaacaaggaaaattaattcgatgttgcaaaaagcagccggacgtccggtgaattttaaagaaatggcggaaacgctgagtgatgtgattgaggccaatatttacatcgtcagccgccgcgggaaattactcggtctcgccatcaaccagaaaattgaaaacgagcggatgaaacaaatgtttgaagaccgccagtttccggaagaatacacgaacagcctgtttaacattacggaaacctcatccaatttgacgattgaaagtgagtacacggcatttccgattgaaaacaaagacctgtttgaaaaaggcctgacaacgattgttccgatcgtcggcggcggggaaagaatcggtacgttgattctggctcgtcttgagcgggaattcgatgacgaagatcttgttttggcagaatacagtgcgacggttgtcggcatggaaatcctccgcgaaaaaacagaagaaattgaagaagaagcgcgcagcaaagcggtcgtgcaaatggccatcagttctttgtcctacagcgagctggaagccattgagcatatttttgaagaattaaacgggaaggaaggcctgcttgtcgcgtccaaaattgcggaccgcgttggcattacccgctctgtcatcgtgaatgcgctgcgtaaactggagagcgcaggggtcattgaatcccgttcccttggcatgaaagggacctatattaaagtattgaataacaaattcctcgttgaactggaaaaagtccgttctaactaacggataagctttacggcaatttgcgccaaaaaaggatacgattcgtatccttttttttattggtatttaatttaccataaaaacgcacaaatactaatatatggatactaataaaatttaaggaaatccgacctgccaatagtgtttcccagtaattgtaaatttttgtaatcctaggcgtattaaggtgcttgaaaaatttttcggcatctttttcgcggtgtgggagtaagggattaatccaaaagtcctactatcaaaaaaattttttgtgatttaagaatatgttcatttacagcccgttatgaaacaattaaaataaaaaatagcaaacaatttgtcgtataaaagaaaaaaatgtcaagtttatgtaatgaggtgtccattgatgagtctctcttccaatacgttgcggtcgcttgagcatgcattgcagtatgcttcgctccggcagaaagtgatttcgaacaatattgccaatgcggatacaccgaattataaggcgcaggatgtcagttttaaaaatgtgctggaggattcggtcaatgccatttcagcgaaccggaccgacccccggcacttccgtttttctgccggggattcaagtccagaaatcgtgacggaatccggcaccacttacaacagcaatggcaacagtgttgacatcgataccgaaatggcgaaccttgccagcaaccagatttattacgagtcactgattgagctggaaaaaggaaagctctcatccttattaaatgtcgtgagaggaggacagtaagatgtccatgttcaccggaatgaacatttcttctgaagccttatcggcacagcgcctgcggatggatgtcatctcttccaatattgcgaacgctgatacaacaagagatacgtatgtaaatgggaaatggcagccataccgccggaaagaagtggtacttgctgcaggaggcggttcttttgcctccatatttcgttcgaaactcggaatgcagggtgctgggtccggcgtccaggtggccggcattgtcgaagataacagcgattttaaaaaagaatacaatccggatgatcctgatgcggatgcaaacggatatgtgacaaaaccaaatgtggatcttttaacggaaatgaccggtatgatcagcgccacccgctcgtatgaagccaatgtcacggcgctgaatgcttccaaagcgatgctgatgaagacgctcgaactcggccaataacagagaaaattccgcatatgaaaggaggcgaatgatgtgtctgttcaatcaatcagtcagacgccgttcgcaagtttgagcgggctgtcgccaaaatcagcaggcgccgcttcgtccgctaacggctccgtttcattttcggacctgctgaagcagtctgtcaatgaactgaacaaacagcagaaccattccgacaccttgattacaaaactatcgaacggcgaaaatgtggacctgtaccaggtaatggtcgccgtacaaaaagcaaacctttcgatgcagacggcactcgaagtccgaaataaagcagtcgaaggctataaagaaatgatgcagatgcaagtgtaacgttctgatccggcgtacataaaagccgtttcccggccgtaacgcccggatcctttccgtctgccctaaaggcgaaaaggatgccggaacgtttgctgtccgactgttctattgatgaaacaccgtgaattttttatcccgggggataatgatgaatgaaaagttaaaacaatcttttcaaaacctgaaggggttttggaaaagcaggagcaagaagcagaaaacaatcggcatatccgccgttgcccttatgctggtacttgctgccggaatcacttattttatgacaaaaacaaaatacgcgccgctctacagcgggctggatgtctccgaaacaggatccatcaaggacgaactggaccaggaaggcgtaccgtccaaaatcacggatggtggcaaaacgatcgaagtgcctgaagaccaggtggacgatttgaaagtcacattggctgcaaaagggctgccaaagaccggcagcatcgactattcttttttcagccagaatgcaaaattcgggatgacagacaatgaatttaacgtcgtaaagctcgatgcgatgcagacggaactggaaaatctgattgaacagatggacggcgtcgaaaaagcaaaggtgatgatcaatcttccgaaccaaagcgtcttcgtagccgacagccaggcaaaagcttccgcatcggttgtcctgacgttaaaacccggttatgaattggaccaaaaccagataaaagccgtttacaatcttgtttcaaaaagcgttccgaatcttcctaccgataatatcgtcattatgaaccagaattttgagtactatgacttaaattcttcaaattcttccggaaatgcttatacacagcagcaggcgatcaaaaaacaaattgaacgggatattcagcagcaggtgcaaacgatgctttccacactgatgggtgcaggaaaagcggttgtcaccgttacagcggatatcgattttacgcaggaaaaacgcgaggaagatctcgttgaaccggttgataagacgaatatgaaaggcattgaaatcagcgccaaaaaaatccaggaaacataccagggtacaggcgcagcagccggaacgccatctggcagtacagattctgtcggctcttcgtatgtatccgggtcgaacgggaacgggacgtattccaaaacaagtgacacgatcaactacgaagtaaaccggattaaacggaaaattacagagagcccgtacaaaatccgcgatctcggcatagaagtcatggtcgagccgccggtcagaacaaaacggtcttccttgcccgcttcccggttaaaagatattaaatcgatgctttctacgattgtcagaacgtcgattgacaagtcaagcggcacaaggctgaccaatcaaacggttgccgataaaatcgcagtttccgtccagccatttgcagccaatgcgccggagaaggcgaaaaaagcttcgattccgtggtgggtatacgcgattggcggaggtttgctgctcgtgatagccgggctcatcttcttcttgatccgcaacagaaggcgggccacttcggaggctgaagaagacatggcggaagaaacgccggaaaaaccggcaccgccccgcattccggacgtaaatgaggaacaggaaaccgacgcttcagcaaggcggaaacagcttgaaaaaatggcaaaggaaaaaccggatgagtttgcaaaattattgcggtcatggctttccgaagaataggagggaaacaagatggcaagtaaagaaaaaacattatccggcaaagaaaaagcagccattctcttgatttctctcggcccggacgtatcggcatccgtctacaaacatttaacagaagaagaaatcgaaaagctgacgctggaaatctcaggcgtcagaaaagtcgacaatgacacgaaggaaaaagtgctgaccgaatttcaccatattgctttggcacaggactatattacccagggcggtatcggttatgccaaaatgattctcgaaaaagcactcggcccggaacaggcggcatccatcatcaaccggctcacttcatcgctgcaggtgcgcccgtttgattttgctagaaaagcagatgcggcccagattctgaattttatccaggatgaacacccgcagacgatcgccttgattctgtcctacctggatccggaaaaagccgggcagattctttccgagcttccgcctgaaatgcagggggacattgccagaagaattgccttaatggaaggcacatcccctgaattatcagcgaagtggaagccattttggaaagaaagctgtccgcgacggtgacacaggattatacgcagacaggcggggtggaatccgttgtcgaagtgttgaacggggtcgatcgtacgacagagaaaacgatccttgactcgctggaacagaaagatcccgaacttgccgaagaaatcaaaaaacgaatgtttgtatttgaagatatcgtcacccttgacaatcgttccattcagcgcgtcatccgcgaatgcgaaaatgaagacctgcttcttgcactgaaagtctcaagcgacgaagtaaaagaaattattttccgcaatatgtcgcaacggatggccgattccatgaaagaagaaatggaatatatgggcccggtgcggctgcgtgaagtcgaagaagcccagtcgagaattgtgtccattatccgcaggctggaagacagcggcgaaatcattatcgcaaggaacggaggcgacgacatcattgtctaatattattaaaacaaagcaagatgcaggtgttgtttccaaaatgcgcgtaatcagcgtgcgccggctcccggctttgcccgaagaaacgggagatgcaaccgctgtgaaagaggatattttcgcaaaatatcaaaccgaggcagagcgcctgcttttagacagtcaaaaagaagcagaagcagtacgccggcaaattgccgaagagaaaaaacagtgggagcaggaaaaagcaaagctcaccgaacaagcacagcgccaagggtttgaagccggttatgcagatggccgcaaggaagggtttgaaagcatccgcgaccatttaaacgagtccattgacatcgtcaaccgttccaaagaggcgttcaaaaaacatttagaagcatcggaaaaagatattttggaaattgcgatgaaagcagcggggaaaattttgcaagacacacttgaaacatcccccgaaaaaatgtttgccatcgtaaaaaacgtattaaaagaagcgactgggtataaagaagtcgatctccatatccatccggggcagtacgccttcgtcatggacaacaaggaagaactggatgccctcttcccgaacgatacaaaatgctatgtctacccggatgattcgcttgaaccgtaccaggtctatattgaaagcggcagcggcaggattgatgcaagcattgacagccagctgtctgaacttaaggcaaagcttttggaactgatcggggaggatgcggaatgaaagcaaccgatctcttagactatatacccgaaattgggacgtttaaacattacggaaaagtaaaaagagtgatcggcttaatgatcgaatcactcgggccggaaagctccatcggtgacgtctgttatattcatgtggataacaaaaaaaatacgaaaaaaatcattgccgaagttgtcgggttccgtgacgggaatgttattttaatgccttatacgaacatccaagaaatttctcccggcagccttgtggaagcaacagggaaaccgatgcgggtgaaagcaggcccacggctgttggggaaagtcattgatcctttgggcgtgccgctcgaccattccccgcttcccgccggcctaaaaccgattccgatcgaccggacgccccccaacccgctcaagcgcccgccgatcagggaaccgattgagcttggcgtccgcgcgatcgacagtctgctgacggttggaaaaggccagcggatcggcatatttgctggaagcggcgtcggcaaaagcaccctgctcggcatgattgcacgcaacacaaatgccgatctgaatgtgatcgccctaatcggggagcggggcagggaagtaagggaatttattgaacaagatctcggccctgaaggtttaaaaaagtccattgttgtcgtggcaacaagcgaccagccggcattgatgcggattaaaggcgcctatacagcaacagcgatagcggaatatttcagggaccaggggctaaatgtcatgtttatgatggactcggttacccgggtcgcgatggcccagcgtgaagtcggactggcaacgggggaaccgccggctacaaaaggatataccccgtccgttttcgcgattttgccgaaactttttgaaaggaccggaacaaatgagtccggcacgattaccgggatctacaccgtgcttgtcgacggggatgatttgaatgaaccgattgccgatacggtgcgcggcattttagacgggcattttgttctggacagggatttggcaaataaagggcaatacccggctatcaatattttaaaaagcgttagccgactgatgagccaacttgccagtcctgcacacaaaaaagccgcagaaaagattcgcgaacagttaagcacttatttgaattcagaggacctgatcaatatcggcgcttataaaccgggcgcatcaaaagaaattgatgaagcgatcgaacgctatccgaaaatcgtttcttttatcaaacaaagcaccgacgaaacctatagtatggaaagcagtatccgggctttaatcggacttgcggaaacgggtgagtgggcatgaattatcattataaattcgagaaaatccttgatgtcaaagaaaaggaaaaagacgaggcgctcagtgcatacaaaaatgcggtacaggcatttgaaaatgtggcccgggagctgtacgcgcttttgaaaaagaaagaagacctggaagcccaccaggctgaaaaaatgaaagcgggcctttccgtccaggaaatccggcattaccggcggtttattgatgatattgaaaaatcaatccattattatcagagcctcgtcatgaatgcacgaaaccggatgaactggcatcagcagaaactgcaggagaaaaatatagaagtcaaaaaatacgaaaaactgaaagacaaagattatggccgttttctgatgaaactgaaaatacaggaagaaaagcaggcagatgaaatttcaacccagactttttatcactaaagcctgaaaaccgggtgatgttatgcgcaaacaaatggaagaaatcgagacagcagcagaagaaaaaaaaggcggtaaactgcagtggtttttttacgtgatcctgattccgctactgtttgccaccgcgatggcgatcattatcgctactatctcgggtgtcaatgtgatcagtaaagcatcgggcctcgcccatcaggtgaccgggatatttggcacaggcgggaatgaaaaagggaagaagcaaagcggcacgttcagtgaaacacagtataaaagccagatccgttctttacaaaaacaggcgtcagaaaaagacaaagaaatcagcaagctgcaatccgaactggacaaaagccaacagaacaatttgaaaatgaaacaaaccgtctctgatctgaagcagcaattgaagaaagcccagcaacaacaggcagccaatcagaaaaaattaaaagaaatcgcaagcacctatgaaaatatgaatccggaaaatgcggctgccattattcaaaaaatgagcgatcaggaagcaacggggatcctttcccagctcagttcggaaacattggcgaacgtccttgaaaaaatgagtgccgataaagcagcaaaatacacccaaatgctcgggcgtacaggatcataagccatccattaaacttgaaaggaggtgaaaacatgaatgtaaattcggctcttcaggctgtaccattttctccgccaagtacgcaaacggctggcgcacagctgcagacgcagccatccgggttttttcagcaattgagccttgccggccaggacagcggccggatgccggaaaacgaggaggcagtggatgtttgccaaaagcttcaacaaaggattgtcgcggttttaacggaaaaggccggggcaacggaacaggctagagaagatggaagccaggaagaaggggctgatatgcagaccatttccgctcttttcaaccggctggtgcggtttgccggcgctgaagacgaaaacagcaaaaaaaagatacaagaaacaaaaacggccatcgaaacaggcgatgccgcagctgccatcatgaatatggcgcaaatgctcgcctccatgccagtcccgtctttaataaagctcggacttgaagatgcggaaacattgctcaggcaggtgggggctgttctaaaaacgtttcccgaaaatacagcagcaggcatcaacatgatgcagacaacggaacaattagcccagttgtccgaaaaaatcggccgttttctcaaggccatttcagcagatgcgctaaacgcggggcagacggtttcaagcgcgccgcaacagccgggcattgccgtaaaagaagaaatattaaaaactgcttatttgcatttatccggcggaaaggcggatccatcgctgtttaaaaaagcacctgttcttcctttatctccagctgccgcggctctaggaatggcttccaatccggatcatgccaactcggcgcaaaatggacgggaaagtaaccaggtattgcttcaaaacggcccagtttctgcaaatggggcgattccggaaatgaacgaagcggtattgccggcaaatgaaagaagcgaaccggctgctgcaggcacgggcaccaccggaacagcactgctacaaacagacaacaatgaagtgacggaagccttatcaaaggatggccgctcatcccggcaggaaggggtgccgtttagtctggcagcagaatccgtcgccgcggatgaaaatgctgggaatccggctgcaaaaccgctgcaggcgggtacttcaggagcggacgcgcaaaatggcaaagcagcgattcggggcaatgcgccaagtgaaagcaggacaggcgggccattgcaaaatcaggcgcccagtgtgcaaacgaccgcccatccagaggcaaataccgggcagcctgcagatggcagccagctcaaggcactaaaagcaacggctgatgaggtgcaggccactgcaagccagcatattgagctcatggaagacgggataccgggaagcaacggcagggtgaagacgcaggcaacagctggtgaaaatggccggattgctgtgccaggccaaaatgcgggtccccagcaggaaaacggaaaactagaagacagcagccggcatgccgcattggatttttcccgggaaatccagcagacaggacaatccggaaacgatagcaccgaagatggattggcaaacggatgggaaaccggaaaaagaagccctgttgcgcataacagcagccatcttcaagcagcagaagaaataaacgggaacggcaatacagccccggcattttcactctcgggcaaagtggaacagctcgtcctttacaccggcgaaaaacataatccggtttcgtaccggcagtttgtccaggaattcgccaatatcattcaaaaggcggcctattccagccataaaggcgcaaacaggctgttgatccggcttgaacctgaaaacctcggttctttgcgcgtggaattgcttgagcaggacggaaaactggcagcaaagatactgacagacactggtgcggcaaaagatttgcttgattcccagctgcagcagcttaaacatgctttggcaggccagcaggtccagttaacaaaaatggatattgaataccgtgacacagcggcacaaaccgcccacggccagcccggggacagcgggggccgcgaacaacggcaacagcagcaaaaacgtcgggaaaacccggaaccgggacatttctcggccatgctcgaaaacaatatgattgatgcggaagcgtaggtgaaatgactttgacttctattattgacccaagcctgctgttaagcaatcaaaatacagctaccagcacgcgtacggggagtaagacgttggataaagatgcttttttgaaaatattgattgcccaacttcaaaaccaggatccgaccaagccaatggacgacacgcaatttgtctcacaaatggcgcagttctcttcattggagcaaatgaccaatctgaaaaacgatatcgacaatctgatcaaactttcgcagcaatcgcagcaaattgcgtatacacaatatatcgggagaacggtttcctgggaaaaaacggaaacagcagatgacggaacagcatccgttaagtcgggaaccgggacgattaccggcatttcgtttggggatgacaatgcagttaccttcacgctggatgacggaacgaaaatcagttcttccgatatgacagggatcaatagcaacacttcaaatgaagcagcattgattcaggcaagccatttgattggaaaaaaagtggcctatacaaataatgccggaaaagaagaaacagcttcggtcagtgccgtttccatccaaaacggcagcctcatctttacacttgataacgggcaaaaagccgcaagcgggcagcttacgaaaattgcaaactaggaagtgattgaatggatcaatcctatccgtccattccattgcagcgaaccacgcctgtgcgttctcttaatggaacgcgagaatccggccaggggaagaaccaaaccggccatttttcggattatttcaagcaggcattgtccgggcagtctgaaccagccacattaaaaatcagcaaacacgccggcgaaaggctgcaggaacgggggattgaactcgacgattccacctggaagcagatcagcgaaaaggtggcggaggcaaagcaaaaagggctggatgagacactggttctggcagatgatgccgcgctgatcgtcagtgcaaaaaatgcaaccgtgattactgcaatggaccggagtgaagccggttcccaaattttcagcaatattaacggcgccatcattttagaatcaccggccggaccggaaggaaggccgcagctgccgaatgacagacgcagctgaaaacaaaaatggagaggggttaatgcaatgttacgttcattatattcaggcgtaagcggcatgaaaaactttcaaacagaacttgatacaatcggaaacaacatcgcaaatgtgaatacttacgggtacaaaaaagggcgtgtgacgtttaaagatgcaatcagccagacgctagccagcgcgacgcccggcacaagcgcccagcaggtaggccttgggtctcagatcggttcaattgataccgttgatacttcaggaagtccggaatcaacggggcgtccccttgactttgcgattactggagacgggtacttcagagtagcagatggcaacaacacgtactatacgcgtgccggcaatttttactttgataataacagaagactcgtcaattcagaaggttttactgtgctgggtacaaatggacaagccatcacccttggcgcaaatgtcaaaagcttttcagtcgcaacagacggaaccattaccgatcaggatggcaatacaattggaacaatcagcattgccactttccagaatcctgccgggctgacaaaagtcggcggcaatttatataccacaacgaattccaatgcggggacggtcacagtaagccagccgggacaagacggtgcaggcacaatcaaatccggctatctcgaaatgtccaatgtcgacctgtcggaagagttgaccaatatgatcgtagcagaacgcgggtttcaggcgaatacaagaattattacgacatccgatgaaattctgcaggaacttgtcaatctgaaacgatagggggaagggggccagggctctagccccggcccgcataatgtgattgaagtgacaaaattaaacggcagggcattctggataaacgctattcatattgaaacggtggaaagcatgccggatacaagaatcatcctgacaaacggacacgcttatattgttagggagtcgagcaaagaaatcgagcaaaaagtgaccgcctttttccggtctgtttctttgcttggaagaaataccggggaggaggggccggaatgaataaaatggtgcggatcatgcttgtgatgatttccgtcattttactggccggcatcatcaccatcatcgtcatctataaatcgaacgaggcaacaaaggcaaaagggccaaacattgatgaagttgtcgattcttccgtggacattgacacgatgacaaccaatctgaaagacaaccacatcgtccagattgccatcaaaattgaaggaaacaataaaaaagcaaaagatgaactgacaaaaagagattttcaaatcaaagacattatgattgacgagctgtcaaatatgaacatgcaggatttgcaagctgaaaaggggaaacaaaagttcaaaacagacataaaaaaccggttaaataaaatgatgcaggacggcgaagttgtaaatgtatatattacttcctttgttatccaataaaagtatgccgcctgttgaagcaataaaggcagagtgcagcaaacaggcagtgccgcagcaggcagtccggcccctgtgcctgtatgtaaacaaggggggtgggtaaacttgccggaagatattttatcgcagtctgaaattgatgcgctgctatccgccctgtcaacgggggaaatgaacgcggaggaaataaaaaaagaggaaacccggaaagtcaaagtatatgatttcaagcgggcactccggttttcaaaagaccagatcagaagcctgacaagaattcatgaaaacttctcaaggattctgacaacctttttatctgcccagctccggacttacgtgcagatttccgttgcatcggctgaccagattccgtatgaggaatttatccgttcgataccgaaaatgacgcttttgacggtttatgaagttcccccgcttgacgggaatattattatggaaattaacccgaacattgcctatacgatgatggatcgtgtgttgggagggtacggggaaagcatcaataaaattgacaaactcactgagattgaaaagaaaatcatgacgagaatttttgaccagaccatcgaccagttaaaggaagcgtggagcgagatcatcgaaatcaatccctttctgactgaactggaagtcaatccgcagtttctgcagatgatttctccgaatgaaaccgtggtcgtcatttctctcaacacgaccatcggcgatacaagcggcatgatcaatttatgcctgccgcaagtggtgcttgacccgatgatgccgaaattgtccgggcattattggatgcagcacgccggaaaggaaccggacccgaataatatccgcctgctcgaagaaggcattaaggaggcaaaagtgccgctcaccgccgaactggggacggcaacaataaaaattgaagattttctgaatctggaaattggcgactgtatacggctgaaccaaaccattgaagagccgttggttgtcaaggtggataaaattccgaaattcattgggcagccgggcaagcaaggcactaaaatggctgtccaaatccttgatatcatagaggaaggggaagaagaacagtatgagcgatgatatgctgtcgcaagaagaaattgatgcccttcttaacggcactgcaaatctggaagacgcaagcgccaaagattccctccgtgtggaagattatctcgattccatggaaagggatgcgcttggggaaattggtaacatttcgttcgggagctctgcgacggcattgtccaccctgctttcacaaaaagttgaaattacaacgcctgaggtcagcattgtccggcacgacaaactggcggatgaatttccgcatccttacgtggccattcaggtgaaatacacggagggcttttccggcgtgaatgtgctcgtcattaaacaatccgatgccgccattattgccgacttgatgctgggcggaaccggcgaaaatccgagcagcgaactggatgagatccatttgagcgcggtacaggaagcgatgaatcagatgatgggttctgccgctacctcgatgtctacggtttttaataaaagaatcgatatttccccgccggccgtttcacttttaaatattttggaaggcgaaggcacggacaagcttccggaccaggatttgcttgtgaaagtctcgttccggattatgatcgggtcattaatcgattcgcagatcatgcagctgttgccgctttcgtttgcgaaaaaactggcgcgcgatctcattcatcctgaacaacccgccgaagctgaaaaaaaagcagaggaaaagcagccggatcaaaatatgcgcggccatgctgcggaaaaaccggctgagcctgctcaaaatgcagcaaaacaggagatgtaccaaaatgtgcagccagctgtttttacgagttttgaagaaacagcgccgcgcgttgaaacgaaaaatctggacatgctccttgatatcccgcttgaagtgactgttgaactgggcaggacatcgaaaacagtaagggaaattcttgagatgggcgccggctccattgtggaactggacaagctcgccggagaacccgtggatattctcatcaaccatcagttaattgccattggggaagtggtggtgattgatgagaacttcggtgtgcgtgtgacagatatcgtgagccagaaagaccggctgaaaaaactgagataatgggggaagatccaaatggcaaagaaaattttgattgtagatgacgctgcgtttatgcgcatgatgattaaagacattctgacaaaaaacggatatgacgttgtcgctgaagcgggagacggcgcacaagcaatcgaaaaatataaggaacaccggccggatcttgtgacaatggatattacaatgccggaagtggacgggatcagcgcgctgaaggaaattaaaaaaatcgacccggatgcaaaagtcatcatgtgttcggcaatgggccagcaggcgatggtcattgatgccatccaggccggtgcaaaagactttatcgtcaaaccgttccaagctgaccgtgtaattgaggccatccaaaaaacgctcggctgacgatgccaggaaggtgacaatgatttgcaaagccaagtgacgaaggggcttttgctgtttgggattctgctgtgcctgctgtacgggttttcggcacccggcaatgccctcgcggcttcttttaacggaaatgtgaaagaatgtatcgaccatccgaaacagtgtcaaaaacaaacggacggaaaatccgaaagccaggctacacaatcggaaacggcaaatccggcggtaaccttcggggatattgcgcggatgatcctcgcacttattttcgtgatttgtttactatactttgttttaaaatttgtcaacaaaagaagccatgcctatcaaagcagtaaaatgatacagaatttcggcggcacgcctttgggcggaaataagtcgctgcaaattgtaaaagcgggcgacaggattcttattttaggtgtcggggacgatgtgcagcttgtcaaagaaattgatgacgaggaagaggtcaggcagttcgttgaccagtacaatcaaaagctcgagcagcaactggaaccgcgcgatattgcgacaaggctcataaaagcggtgaaaaacagggaaactggggcaaaaacagaagcaaccccgttcgggcatttgctgaagtcgcaaattagcgcgatcagggaggagcgggcgcaggcgatgaaagaactggaacaaagggagaaggagaaacagaacgatgaatgagttgttgaatacattaagcagcacatccggcgataccgtttccctttcggtcaaaatccttttgcttatgaccgttctttcattggcaccgagcattttaatcctattgacttcttttacgcggattgtcattgtcctgtcttttgtccggacttcgctcggcacgcagacagccccaccgaatcaggtgatcgtaggccttgcgctgtttctgacgttttttatcatggctccgacgtttcaacaggtaaataaacaggcgctcacgccgttgttccatgataaactgacgctggaagaggcttatgacaaagcccagaagccgtttaaggaatttatggcgaaagagacccggcagaaagacttgcagctgtttttggattatgcccataaaaagcagcctaagtcggtgcaggatattccaatgacaacccttgttccggcatttacaatcagcgaattaaagacggcttttcaaatgggcttcatgattttcattccttttcttgtcatcgatatggtcgtggcaagtgtcctgatgtcgatgggaatgatgatgctgccgcctgtgatgatctcgctgccttttaaaatcttactgtttgtgctcgtggacggatggtatcttgttgtgaagtcgctgcttgaaagtttttaaagaaggtgaatggattgagtgaggaaatggtcatttcactggccgaaaaaggcatcatggtgacctttatggtctgcggtccgcttttattgattgcgcttgtcgtcggtatgattgtcagtatcttccaggctgcaacgcaaatccaggaacagacgctggcatttgtcccgaaaattgttgcggtgctgctcggccttgtactgcttggcccgtggatgctaagccacatgcttacatacacaaaagaaattttatccaatttaacacaatatataggttaacatatggatgaactgattccgtcattcagtatatttttactcgttttcattagggtcaccactttttttatcatgatgccgttattttcccacaggagcgtaccggcccggttccggatcggccttggcttctttttgtccgtccttgtgacatacacgatccatgccaaaccgttcaccatggatggcgcctattttatgctgatgattaaagaagcacttgtcggcctgctgcttggctttgtagcctatttcattttgtcggccgtgcaattggccggtacgtttatcgattttcaggcagggttttccatggccaatgtgattgatccgcaatcaggggcgcaaacgccgcttaccggggaatatttgtacagttttgcgctgcttttattgctttccctgaacgggcaccacctgcttttggacgggatttattacagctattcgtttatcccgctcgatcaggcatgggtccatctcgggtctttcaatctcgcaaaatatttggcaacccttttggcccgtgtgtttctcgtcgcttttcaaatgtcggcacctgttgtcgccgtcctgtttttaacggacattgcgcttggcatcatcgcccggaccgtaccgcagcttaatatttttgtggtcggctttccggtcaaaattgccgttagtttgatcgcgctggcggtggcaatgggcacgatttatatcgcggttgaacatttgtttgaatggatgtttgttgcgatgcggaattgtatggcactgttggggggatccgtttgaagcacctctcactcgatttgcagtttttcgcaggggagaaaacagaaaaggcaacgccgaaaaagcggcgtgatgcccgcaaaaaggggcagacagccaaaagccaggatatcgtaacggctgtcatgcttcttgcggtgtttctgttcttgtatttcggggcctcctcgatcggaagcccgatgatggcactctttcgccaggctttttcaaaatatatgctgcaggatgtcacggagcaaagcgttggcaaattgatgaccggcgtcatgaaacagctggcttcgatgcttttgccggttatggccgttgcccttttggccggcgtggtcggaaatgtggcccaaaccggcctcctttttaccggtgaagggctgaaaccgaatataaacaaaatcaatcccgtcgccggattaaaacggattttttcgatccgggcgcttgtggaattgttaaaatccgttttaaaaatggcggtggtcggcgttgttgctttttacgtcatttgggccaatatccaggatatttcaggcctgccgtttaaaagcgcgggcgatacgctggctgcagtcgggcatctcgccgccataaccggcatcagcgcttctgttgccctgtttgtgctcgccgttcttgattacttgtaccagcgtttcgattttgaaaaaaatatccggatgtccaagcaggaaatcaaggaagaatttaaaaatatggaaggcgacccgctgattaaatcaaaaatcaggcaaaagcaacgcgaaatggcgatgcggagaatgatgcaggaagtgccgaacgccgatgtcgtcattacgaacccaacgcattttgccgtctgcctccgctacgatgaaacaaagagcgatgcgcccatcgttgtggcaaaaggagcggacttccttgcccaaaaaatcaaatcgatcgcaaaagagcatgacattgtcatgctggaaaacaggccgctggcaagggcgctttatgagcaggtggaagttggcggacgcattccggaacagttttttaaagcagtagcggaaattttggcgtacgtatacaaaatcaagcataaaatttaagctttttcatgcaagttaggagagaaaccgtatgagtgcaagagatttgagagatattcccgtgatcgcaggtgtcattttaatcgtcactatgctaattatcccttttccgacatgggcattgagctttttaattatatgtaatatttctcttgcattgatggtacttttaatctcaatgaatatgaaagagccgcttcagttttccgtctttccgtcattgctgctcattttaaccttattccggctcgggctgaatatctcaaccacccgctcgatcctttccaccggcaatgccggcggggtcattgagacgttcggatcgttcgttgtcggcggcaacatcgtcgtcgggctagtcgtctttacgattttgattattatccaatttattgtgattacaaaaggcgctgaacgggtggctgaagtcgcggcccggttcacgctcgatgcgatgccgggcaagcaaatgagcattgatgcggacttgaatgccggcatgatatccgatcaggaggcgcgcgctcgccgggaaaaagtcagccgggaagcagacttttacggcgcgatggacggtgccagcaaatttgtcaagggcgatgcgattgccagcatcattatcgttctcattaatcttatcttcgggatcattatcggcatgacccagctcggcctctccattagtgatgccgcgagccagttttcgctgatgaccgttggcgacggcattgtcagccaggtgccggctctgctcatttcgacagcaaccgggatcgtggtcacgagggcggcatcagacggcaatcttggccaggacgtaatggcgcagatgctgtcctatcccaaaatgctatatgtcgcgggcggcacgatctttctgctcggcttgtttacgccgattaatgattttttaaccatgacggtggcagcggcgctgttcatcggcggtttccggctccagcaagtcccgaaaaagacggaacaggaaagcgcggagaaagcggaagaactccagcctgaggaattgaaaagcccggaaagcgtcatgagcctgctcgatattgacccgatcgaattcgaattcggctacggcctgatcccgcttgtggatgtcaaccaggggggcgatttgcttgacaggattgtcatgatccgcaggcagctcgccatcgaactcggcattgtcattccggttgtccggatccgcgataatatccagcttgagccgaatgagtaccggttgaaaattaacgggaatgaacttgccaaaggcgagcttcttctcgaccattatttagcgatggcgcccggcgaagatgacggctccgttgaaggtattgagacggtcgagccggctttcggaatgccggcaaaatgggtgacggaagaacaaaaagaacaggcggaaatgatgggctatacggtcgtggaccccccgacggttgtctcgacccatattacggaaacgatccggcaaaacgcgtatatgctgctcggaaggcaggaaacaaaagcgttgattgaccatttgaaagagtcgtacccggtgcttgtggaagaggtaacaccgaacccgttgtccgtcggcgagatccaaaaagtgctggcgaatcttttgaaagaaaatgtttccatccgaaaactgccgattatctttgaaacgttagccgactatggtaaattaacaacagataccgatttgctgacggaatacgcccgccaaagtctcgcgcggcaaattacggcgcaatatgcgcaagacgggcaattaaaagtcatcaccgtttcggggaaagtagagaaattgattgcggatggcatccagcgtacggaacatggcaattatctttccctggacccgtccgtgtcgcaaaaaattgtggaatccgttgcacagcaggttgagagggtatcgcttaccggcagttccgcggtcatcctttgttcgcctgccatccgcatgtatttgcggcaaatgattgaacggttctttcctcaggtgtcggttctttcctataatgaactggaagcaaacgttgaggtacaaagcacagggctggtgaacatagaatgaaaattaaaaagtttatggcgcccaatatgtctgaagcaatgaaacagatccgtcttgagcttggggaccaggccgtcattttaaattcaaaagtggtccagcacaaaggctttcttggatttatgaaaaagcggaacatcgaagtaattgcagccgttgacccggatgccgggaaaaacagtccggtacaaacggcccctgcccgtggtgaaaaacctgcgcgcgcaccggatgcctccgtccgttcagaaaaagaaagcctgcaaaaagaaatcgcagcgctgaaaaaagtggtccaggaagtgtcgaaatttgggaatcccgcttaccaaaagtatccactgccgattcaaaaacgattaaacacaggtttgcagcaagggctggatgaatcgctgctggttgtgatcggagatgccctgtatgaagaatgggagaaagcaaacggcaatctgacggaaaacgaaattttaaagcaggcgaaggcactgcttcaaaaaaagctcgcccatttgacatacggggggagccagaaaaagtacgtgaacctgatcggcccaaccggtgtcggcaaaacgacgacactcgccaaaatggctgcacaggccgtgctcgaaaaaaaagaaaaaattgctttcattacaacggatacgtatcggattgcagcgattgaacaattaaaaacgtatgcaaacctgctgaatgtgccgctcgaagtggtctataaattgtccgatttcaaaaaagcgatcgaaaaattttccgattttgaccgtgtttttatcgataccgccggccggaattacagggagctgcaatatgtccgcgagctttcaggactcatcgattttcatgcggaaatggaaacctttctgacgttgtcgttaacgatgaaagagaaagatatgaaagccgtttttgacagttttcaaagcatcaggattgaccggtttattttcaccaagctggatgagacatccacttacggcgctgcgatcaatttaatggaacagtatggaaaaggctgtgcttatgtgacaaacggccaggatgtccctgatgatatgctcgaggcaacccccggtatttttgccgaatacgtatttggggagaacgacaaatgagagaccaggcagaacagctgcgcgcaaagttaaaaatgcaacacgggattccggcaaaaacgcttgcagtcgcaagtggaaagggcggcgtcgggaagtccaacatctcggtcaatttggcaatggcacttgcagaaaggggaaaaaaagtccttttatttgacctggatgtcggcatgggcaatatccacgtccttctcgggcttgacgcaccatacacgatctcggactttatcaaccggaatatcccacttgcccaaatgatatgcgacgggccggccggtatttcttatatttctgccggcaacgggtttgcccagattgtcgagatggaagaagctgctgtaaccaggcttgtcacagagctcgaactgctccagtatgattttgattacatcattttcgatatgggtgccggcgccgcgccatcaagccttaaaattttgctttcggctgatgatatttttattgtcacaacacctgagccgacagcgattaccgatgcttattcgatgatgaaatatatttacatgcagcaattcagcgcccccctttatttaatttgcaaccgggcggaaaaagaaaaagacgggatgttgacgttaaaccggcttcaatttacagttaagaaatttttagggaaagaagtgaacattctcggcgttgtgccggaagatgcgcatgtaaaaaaagctgtatcaaggcagctgccgttttacagtgcatttccacattcagcggctgcaagaagaatcgatgaattgcttaaccgctatgtatccggcaattcggacgggcccagccagcgcgcaccggtatttatgcggaaactgagggggcttttgttgaaatcttaaacatgcatgacaataacagggcaatgaaatgacagttttgaaaaacagggggcagatttgtgaaatgggaaaaacgtaaaggaagcgaaccggaaaaaaacacgcaacctttgtccgatcctgttcaaagcggacggatagcacagaaaaaattggtttgcatcggaacatcgaccggaggcccgcgcgccctgcaaaccgttctttcttccctgcccgggaatttggaagcgcccgttctggttgtccagcatatgccaagcggatttacaaagtcgcttgccaaccggctgaatgccatttcaaacatcagggtgaaagaagccgaggatggcgaaatgctcaagccgggggcggtttatattgcgcccggggacttccatatgggcgtggaggcgcacggcgcacatctctttatccagcttgagcaatccgcgccggttaacgggcacaggccggctgtggataaaacatttgaatcggtgagcatgctaaaaaactatgaaacacttgccatcatcatgaccgggatgggttcagacggaacaaaaggtttgatcgccttaaagaatcgcgggcacgtaagagcgattgccgaagcggaagaaagctgcatcgtttacggcatgccgagaagtgccattgccgcgaaagtggtggatgaagttttgccgctggaaaaaattgcggaggcaatcatgaaatttattagtgattagggtgtggtatagatggaaatgagccagtacttggaagtgtttattgaagaaagcagggaacatatccagtcgttaaacgaaaatgtgctgctacttgaaaaaagcccggatgacttgcaaattgtcaatgaaattttccgttccgcccacacattgaaagggatgtcggcaacaatggggtatgaagatctcgccaatctgacccataagatggaaaatgtgcttgatgccatccggaacgggaagctgtctgtaaccccggacattatcgatgtgatttttactgcggtggaccatctggaagcgatggtggaatcggttgcaaacggtggggacggcaaattggatgtgagcgggacgatcgcccgcctcgaagcggtagatcatggttcagccggagagaagaagacggagaaagaaacttcagctgcgacagcggaaaaggcggaaacagaggaagacgaatttgaccagtacgaacaggccgtgattgttcaatcggaagaacaagggtacaactgttaccagttcacggtaaaattgcgcagcgactgcctattaaaagcggcgcgggtattcatggtctttgatatccttgaaaaatgcggcgagatcatccattccgatccgccggccgaccagctggaagaagaacagtttgacaatgaatttaaagtgacactgatctcaaaagaagacagggaagagattcgcgaaaaaatctgcaaggtgtcagagattgaagatgttaaagcaagcaccgtgactctcacaaagcaggatgggcgcggtcaacacccggaaacggcagaatcggagaaaccggcagaaccagagcagaaaaaacaggcagcaccggacgcagcggaaaagcatccgcaaaaaccggcaaaaaagcatccgcaaaaacagaaacatacaaccaagacgatccgtgtgaacatcgagcggctggataatctgctgaatctatttgaagagctggtcattgaccgcgggcgcctcgaacaaattgcaaaagaagtgaaccatccggagctcaatgaaaccgttgaaaggatgtccagaatttccggcgacttgcaaacgattattttgaacatgcggatggtgccggtcgaaacggtgtttaaccgttttccgcggcttgtccgccagctggcaagagaattgcacaaaaaaatggatctcgacattatcggcgccgaaacagaactggaccgcaccgtcattgatgaaatcggcgacccgcttgtccatctgatccggaattcgtgcgaccacggcattgaacagccggaagaaagaaagcgggcagggaagccggaaacaggaaccattacgttaaaagcttatcacagcggcaaccatgtgtttatagaaattgaagacgacggcgccggcattaaccgtgaaaaagtgttggaaaaagccattgaaaaaggcattgtcaaaaaggaagaagccggcagtttaacagacagccagatttataacctgatttttgaatccggtttttcaaccgctgaccatgtatccgatatttccggccggggtgtcgggctggatgtggtgaaatcaaccattcaatcattgggcggctcgatttctgtccattccgcagaagggcgcgggtccgtctttacgattcagctgccgcttaccttatcgatcatttccgtcatgcttgtggaaatcgggacggaaaaatatgctgttccgttatcctctattgtagagacggccattattaagaagggcgaaatattaaaagcgcatcaccaaaaagtgatcgatttccggggcaaagtggtgccgcttgtctttttgaatgaaatatttgaagttccggatgcaaagcaaaatgatgaatatgtctccgtactgattgtgcgaaaaggggaaaaactggctgcatttgtggtggacgcctttatcggccagcaggaaatcgtattaaaatctttaggaaattatttaacgaatgtatttgccatatcaggcgccaccattcttggaaacggccaggttgcccttatcatcgacagcaatgcgctgatcaaatagaaaacaaggcgcttgccgcccatttcattgcccaggaaagaggttgagatcgttggagaaagtgatcgtatttcagttgaatgataaagagtatgccctgccggttacgcaggttttggccattgaaaagctgcagcatattacaagagtgccgcttaccgctccttttatacttggcgtgatgaatttacgcggtatcattattccggtcattgatctgaaaaaacggtttggcatggaggatgacacggacgctgataaggaggaacgcaagctgatcatcgtccggtttggagaaattgaaacgggcctgcttgtggacgaggcgacggatgttctggatatcgacgaaaaaaaagtggaacccgagccggaagtggtaaacgcgggcaaagaggactttatttccggtgtggcgaatataaacgagaggcttttgctgctgcttgatttagaaaaaactttaacgccattacaataggggtattttaaatggatattaaaaataaaatcacaaatcttcaccttgatgtcttaaaagaaatcgggaatatcggagcgggacatgccgcaacggcgctttccaaattgctgcataaaaaaatcaaaatgacggtcccggatgtccatattgcctcctttgaagaaattatggagctgatcggcggcgctgagctcgttgtggtgagcgtgtttttgcggattgaaggcgatgcgcccggcaatatttttttcatcgtgccggttgcccagggcgaaagattcattaaagaaatgatcgaggatccgtcgttctcctttgaaaagccgccatacccggagctcgggctgtcggcgatgctggaactgggcaatattttgtcggggtcttatttaacggcgctttccgattttacgaagctggatatgctgccttccgtcccggcactcagcattgatatgttcggttccattatcagctatggtttgattgaactgtcccaggtcagcgattatgccatcgtgattgatacagtgctgagcgatgagcaggcggaaaattccgatatgaaggggcattttttcctctttccggatccggattcttatgaaatcctattccgtgcgctaagggttgaattagatggatagcgaaatgaacattgtcaaagtgggcattgcggaaatgaagatcgtcacttctcccggcctgatcaggacaaccgggcttggctcatgcgttggcgtcgttttgtacgatttgccggctaaaacagccgggcttgcccatgtaatgctgccttcatccttcattgcgaagaatggagagcatatgaataaagcaaaatttgcggataccgctatttttgaactgatcggcatgctgaaaagcgcaggctgccaccagagcagactgctagcaaaaatcgccggcggagccgaaatgttttctttttcttccatgaatgaagcgatgcggatcgggccgcgcaatgtcgaggctgtaaaacaggaactgaaaaagtaccgcattcaattggtggccgaagataccgggggaaaaagcggccgcacgattgaatttaacccgggaaatgccgtactgaccgtgagaacggtcaaccagggttctgtcgaaatatgacgaggccgcccctttgttttcgggaaaagcgatggcaacaaggagggatgcgatatggcggaggagccaaaacagggtgaggagcagaaagattgggatttgtggcttaaatcccgtgatccggaagccggaaatgcccttgtgaaaagatatatgccgcttgtttctttccatgtccaaagaattgccgccgggcttccccgcaacgtgtcaaaagaggatttaaaaagccttggcatgttcgggcttttggattcattaaacaaatttgatccgtcccgcgaactgagatttgatacatatgcttcttttcggatccgcggcgcgattttggacggcctgcggaaagaagactggctgtcaagaggcacaagggaaaaagcgaaaaaaattgaaagcgccattgaaagtctcgagcagaaatacttgcgcaccgtttctccaaaagaagtcgctttggagcttggcatggaagaaacggaagtctgcacaacgatgaatgaacagttttttgccaatgtcctgtcgattgaagaaacgggcaccgataatgatgaaccggaagcagcatcccggttcgtgtccggggacaggaatgccggccagccggaatccgagctggaaaaaaaggaaaccgtaaaggaactggcggaggccatccgtgccctgtcggaaaaagagcagcttgtgctgagcctcttttatcaggaagaatgcacgctgacagaaatcggcgaagtgatggggctttccacttcccggatttcccagatccattcgaaggccatttacaaactgcggaatattttggaaaaacggctgctgtaatcagagggggtgaatcaaacggttatttttttcctcattctttctttcctatttaatgtgctctccatttttgccatcatcctgctctatttacggcaaaaccgctttgcccgggcagaacaaaacgtcaataaaatggtgaaagaaattgaagacatcttttccgtatacctgatggagttaaaagaagaaaacgatgctttcatcaaaaaaatgaaagcaggcaggatgaaagaggcaagcccgggggaaaaagcagggccggaaacgggacagccgggttcggaaacaaaacaaccgcctgagacagaagaaacagcggaactgaagtcagatgcgctcatccaggtatccgcaaaccgggcgtaccggaatgcggcccggcaaatttcaggggaacaaagcgatgggcagcttcaggaagaaaaaagccttttgcaaaaagtgaatgatttgcaacaaaacgggtatactgttgatgaaattgcccaaaaattaaataaaggccgcacggaaatcgagctgcttctcaaatttcagacaggacgcggataatgcttgattcgcatttttttttatggtatagtaatcgttggtgttatcacacacgcttcatgatttaaaggacggtgctgcttttaagcggtctccttttgaaaaggattggggcggaggaaaaaaaccataggaggaaataaaatgtcagtaatctcaatgaaacaactgctcgaagccggtgtccatttcggccaccagacgcgccgctggaacccgaaaatgaaaaaatacattttcacggaacggaacggcatctatattattgacctgcaaaaaacggtcaaaaaagtagaagaagcttataactttgtaaaagatcttgcaggcaacggcggaaatattctgttcgtcggcacgaaaaaacaggcgcaggaatccgttaaagatgaagcggaacgttccggcatgttttacgtgaaccaccgctggcttggcggaaccttaaccaactttgaaacgatccaaaaacggattgaccgtttgaaacaaatcgaaaaaatggaagaagacggcacatttgatgtccttccgaaaaaagaagtcgtccagttgaaaaaagaacacgaccgtttggtgaaattccttggcggcattaaagatatgcggaacctgccggatgcattgtttgtaatcgatccgcgcaaagaacgcatcgcggtagcggaagcaagaaaattaaacattccgattatcgggattgtggatacaaactgcgatccggatgaaattgactatgtcattccggcaaacgatgatgcgatccgtgcggtcaaacttttgaccagcaaaatggcggatgctattgtggaagcaaaacagggcgaagaaggtgccgctgaagttccggccgaatccggcgaagcagcgggcacggaagaaacgactgtcgaagcctgatccgttttccggccggggtttgacagcggccgcaccttacccaaaatatcccaataaaaaaggtgataagaaggtttgtgcttatcacctttttttagggagacgtacataaacttgaaggaggaaatccgatggcaattacagctcaaatggtgaaagaacttcgtgaaaaaaccggcgcaggcatgatggattgcaaaaaagcgctgacggaaacgaacggcgatatggaaaaagcggtggactatcttcgtgaaaaagggatcgcaaaagcggcgaaaaaggcagaccgcgttgctgcagaaggaaccacttacgtattaagcgaaggcaaccacgccgtcattctcgaagtcaatgccgaaacagactttgttgcaaaaaatgcagaattccaaaaccttgtaaaagaaatcgctgaacatttgcttcaaagcaaaccggccgatctggatgccgctttacaatcaacaatggcaaacggatcgactgtcaatgattttattacacaggcgatttccaaaatcggtgaaaaaatttcgctccgccgttttgccctgaaaacgaaaacggataacggtgcgttcggcgaatacctccacatgggcggccgtatcggtgtgctcactgttcttgaaggcacaaccgatgcttctgttgcaaaagacgttgcccttcatgttgcagcgatgaatccgaaatacatctcccgcgaccaggtttcggaagaagaagtggcccatgaacgcgaagtattaaaacaacaggcgctgaacgaaggcaaaccggaaaagattgtggaaaaaatggtggaaggacgcttgaagaaatacttcgaggaaatttgtgtggcagaccaggcgtttgtcaaaaatccggatcaaacggttgggcagttcgtcgcttcccataatgcaaaagtggcagattttgtccgttatgaagtcggcgaaggcattgaaaaacgccaggaaaactttgctgaagaagtcatgaatcaagtgaagaaaaactagttttaaaaggggaacacagtgtgttcctctttttaaaagaaggcaggattttaaccttgcaaaaaaaacgccccgtttaccggcaaagatggaccggggcaattttacataaccatattggaggttcaaaatggacacccctaaatataaacgtgtcgtattgaaattaagtggtgaggcattggctggagagcagggctttggtattcatccgacggtcatccagtccgtcgcgcggcaagtaaaagaaattgtcgagcttggcgttgaagtggcgattgtcgtcggcggcggcaatatttggcgcggcaagatcggcagccagatgggaatggacagggcaacggctgattatatgggcatgctcgccacggtcatgaatgcaatggcccttcaggacagcctggaacagagcgacgtggaaacacgcgtgcagacttccattgatatgcgccaggtggcagaaccttatatcagaaggcgggccatccgccatctggaaaagggtcgtgtcgttatttttgccgccggtacgggcaacccgtttttctccaccgatacgaccgccgcgctgcgtgcagcagaaattgaagccgatgtcattttaatggcaaaaaataatgtggacggtgtttattctgccgatccgaaactggacaaagatgctgtgaaatatgaagagctttcatatctggatgtcatcaaagacggcctcgctgtcatggactccaccgcgtcctctttatgtatggacaatgacatcccgcttatagtattctcaattatggaggaaggaaacatcaaacgcgccgtcttgggcgaaaccattgggacaatcgttagggggaaaatatgatggcaaatcaggtcattgacactgcaaaagataaaatggcaaaagcaatccaggcttttcagcgcgaactcggctccatccgtgcggggcgtgcaaacgcggccctgctcgataaaatcacgatagattactacggcgctaggacacctgtaaaccagcttgcgtccatttccgtgccggaagcgcgcctgatggtgatccagccgtatgataaaacggtgctgggtgaaattgaaagggccattttaaaatcggatctcggccttacgccgaataatgacggttccgtaatccgcctttccatcccgcctttaacggaagaacgtagaaaagaactggtgaagctcatcaaaaaagaagcggaagaagcaaaagttgccatccgtaacgtgcgccgtgatgccaatgatgaactgaaaaagcaggagaaaaacggtgagattacagaagatgagcatcgtggtttcgcggaagacgttcagaaaatcaccgaccagcacattcaaaaaatcgataaaatgacaaaaacaaaagagcaggaaattatggaagtctgactgccggacaaaaaacttccgttggcaagcggccgatggaagttttttattatgttatcagtgcgcgcttttcccgggagcatggaatgttccggttctaaaatcctgtcatattgccggaaaatggggctacacacgcgtttaaaaggggatacaaagccggttttccatacacccccaaaccaaatggccggatcgtttaaaaaacagaactacacaaacgcatccattttctctataatagaggttggcaaatggaatacaaaggtcataccacttttgccggaaacgactgaacacgtatggccgcggtaccgtgcataaagttgcaggcggataccatttggagggcaaatgtgcatatgaatttaaaaagatggaaatctttcgataaagaaggccgcgacacgacaacccgcggcgaaaaagtgaaagctgccgccatcccggaacatgtcgccatcatcatggacggcaacggaagatgggcgaaaaaacgccatttgccgcgggtggccggccatcacgaaggcatgaaaaccgtccggaaaattacccgtatcgccaaccggctcggaatcaaagtattgacgctgtatgctttttcaacagaaaactggaaacggccaaaattagaagtggaatacttaatgaagctgccggaagaatttttatccacttatcttcccgagctgaaagcggaaaatgtgaaagtgcagatgatggggtgcaaagaaaaaatcccgcttcatactcaaagggccatcaataaagcgatcagtgaaacggcgcaaaacgacgggctgattctcaattttgcgttgaactacgggagcagggatgaaattatgcgcgccgtgagaaatattttaatggatgtaaaaaatggtataatgaatgaaaacgagctgaccgaggaagtgttccaccagtacttaatgacgcacggcctgcaggaccccgaccttttaatccggacgagcggggaaatccggctcagcaattttatgttgtggcagctggcgtatacggagtttgtgtttaccgatgtgttatggccggattttaatgaggaacattttttaagtgcgattgaagaatatcaaaaacgttcccgaagatacggcggtttaaaaagtgaggagcagtctgaatgaagcaaagaatcattacagccatcgtggcagcagctttttttattccttttgtgatatacgggagatggccgtttgcgctgctcgtgtatgccatggcgaccgttgcgctatacgagctgttgcggatgggaaaacagtcatttttttcctttggcggcctcctttccgtcctgctgctttggctgattttatttccatcaaagtatatgcatgtcatcgcacaaacaggcttttcaaagcttgaattggtgtatatgatcgtgctgctttttcttgcctacatggtggtgacgaaaaaccggtttacatttgagcaggctggtttccacattttgtccgccatctacattggcatcggcttttattattttattgaaacaagaaatgcgccagatgcgggcataacctatattttttacgccctgtttctcatttgggcaacggattccggcgcttatttcgtcggacgggcttttggaaagcataagctgtggccagagatcagcccgaataaaacggttgaaggcgcgcttggcggcgtactgtgtgcggtcattgttgctgtgctgttttttttctattccaatatcggcctcgggctcgggcggctcatggtgtccacggtcgtcctctccgttttcggccagatcggggatttggtggaatccgcgtataaacggcattacggggtaaaagacgcagggaaaatcctgcccgggcacggcggcattttggaccgctttgacagtttattgtttgtcctcccgcttatccattttttaaaaatgatggcgggatagaaaaagaggtggatagcattgaagcaaatcagcttattgggggcgacgggctccattggtacacaaacgctggatgtgatccggaaccatccggaagcattccggctcgcggccttttcagcagggagaaatctcaatttaacgaggaaaattatttcggagtttcatccggcgcttgtctctgtcgctgacaaagaagactgtgcccggctgaaaaccgaattcggggacagcccggttgtgctctacggggaaaaagggatggtcgaaacggcggtatatgccgaatcggatattttggtcaatgcggtgcttggcagtgtcgggctgttgccgactttggaggcgatccgggcggggaaaactgttgcgatcgccaataaagaaacgctcgtcacagctggccacctcgtgatggatgcagcaaggcgcgccgaaactgaaattcttccgatcgacagcgagcattccgccatttttcaatgtttgcaaggggaaaaccgggatgagatcgaacggctcatcattaccgcatccggcggcagtttccgtgattatacaagggaacagcttgaaaccgtcaccgtaaaagatgcgctgaaccacccgaattggtcgatgggcgccaaaatcacggttgattcggcaacaatgatgaataaagggctcgaagtcattgaagcacactggctgttcggccttccctttgaaaaaattgatactatcctgcaccgcgaaagcatcatccactctctcgtcgaattccgtgacagcagcgtaaaggcgcagctcgggatgcccgatatgcgcatcccgattcaatatgcgctcggatttccaaaaaggttgccgctaccggatgcaaagcggctcgatttggcggaaatcggccggcttcattttgaaaaaatggatgaagaacgcttttactgcctgaaacttgcctatgaagccggaaaagccggcggatcgatgccggccgtgctgaatgcggccaatgaggtggcggtccatgcctttttgcaggaaaaaatttcgtttttgcaaattgatcagttgattgaaaaggcgcttgcaaggcataatgtaattatacaccctgatttggaaacgatctgggccgttgaccgtgagacgcgggactatgtggcctcgctcatataagcgggagcttgcccggagttcctgaaaaaggcggagactattttaaagtaaggtggtattcatttgacgacagttatagcctttattttgatttttggttcacttgtcattttccatgaagccgggcatttctttgttgccaaaaaagccgggattttatgccgcgaatttgcgatcggattcggcccgaagatcctttcgtttaagaaaaacgaaacgcagtataccgtccgcctgcttccgatcggcggatacgtacggatggcgggggaagacccggatatgccggagttgaagccaggccagcgggttgggctgcttttcgatgaaaacgaagccgttgaaaaaatcgtggtgaacggaaaagaccggtataccggattgcgcatgattgaaacggaatctgcagatctggaacgtgcgcttgtaatcaaaggctatgaagaaggcgatgatgaacacctccggacgtttaaagtgaaaagggatgccgtgcttgtcgaagaccggatggaaatgcaaatcgcgccttgggaccgccagtttgcctccaaatcgcttgggaagcgggcgctcacgatttttgcgggcccgctcatgaatttcgttctggcagcccttgtctttacccttatggccgtggtgcagggggtgccgatgaccgatccggtgctcggaacggttgtcaaggacagtgctgcggcaaaggccgggctgcataaaggggatacagtgatcagcattgacggtgccgaaatctcgacgtggaatgacattgtcgacgtgatccaaaaacaccctgatgaaaaaattacgtttacagtggaacggaacggcaaaacaatggacattccggtgacgccaaaaagcatttcagaggacgggaagaccatcgggagaatcggcgtgaccagcccggttgaccattccccgctgaaagtagccacgtacggcattacacagacatacgtttggacggtggaaatttttaaactgcttggccacctgatcagcggcggcttttccattgatatgctgtcaggccctgtcggcatttacaaatcaacagagaccgtcgccaagtcgggcatcatttatttgtttaaatgggcaggattgttgagcatcaacatcgggattatgaacctgctcccgctgccggctttagatggcggcaggctgctgtttttcggcatcgaagcattgcggggcaaaccgattgaccggcaaaaagaaggcatcgtccattttatcggttttgcgctcctgatgctgttgatgattattgtcacctggaatgatatccaaagatttttcctgtaaagtttccggtttcgagggggttccagcgggccctgttgcaaaagggcctgcttccttacctgctttacggagacggttataaaatggatttgcatttttgatccgccattagcccggtttggcccgctcgtcttcacaagcaacgccaaatcttcgtatttttaccgtgcggatcccttttaaaatctgcatttctagcaccctggcccggcttttgatttacaatctcttaccatccaaccttggacctggtttgctgaatcgggggaatagaaacgaaggaacgtaatcaacgcgactgatctataataaatgaatacgggagtgcgatgtatgaaacagagcaaattgtttattccgacattgcgggacgtaccggcagaagccgaggtgaaaagccatcagctgctgctccgtgccggttacatacggcaaattgcaagcggtgtttatacgtatttgccgctcgcgaaaaaagtcttacataaaattgaagcgattatccgcgaagaattggaagctatcggttccatggaattgctgatgccgtccctccagccggcggaattgtggcaggaatcggggcgctggtattcttacgggccggatttgatgcgccttaaggaccggcatgaacgggactttgcgctcgggccgacgcatgaagaagtgatcacaagtttaattcggaacgaagtaaaatcgtataaacgcctgccgctttctttataccaaattcaaacgaaatttcgggatgaaaagcgcccgcgtttcggcttgctgcgcggacgggaattcatcatgaaagacgcgtattctttccatgccaacaaagagagccttgatgagacgtataaggatatgtatcgggcttataccaatatattctcgcggtgcaaactggatttccgcgccgtattggcggactcgggcgcgatcggcgggaaagatacgcaggagtttatggtgctgtctgaaatcggggaagacaccattgcgtattccgactcatccgattatgcggcaaatattgaaatggcggaagtgaagaccgtttacacaaagccggatgaagcggaaaaaccgctcgaaaaaattccgaccccggggcaaagaacgatcgcgcaaattgcggactttctaaaggcagatcctgaaaaatgcctgaagacccttgtgctgaaagcggatgatgaatatgtcattgtgctggtcaggggcgatcatgacgtaaatgaagtcaaagtcaaacatcttctcggttctgaaacgattgaaatggcagatccggaagccatcaagtcgatcatgggggcgggtcccggttcgctcggccctgtcggcgcgccggaacagatccggattttggccgatcacgccgtccgctatgtagtcaacggcatttgcggtgccaatgagaatgacttccactatgtgaatgcgaatccggagagggattaccgcgtcgatctatacggggatctccgcaatatccaggaaggcgacccgtcaccggacggaaagggaacgatccggtttgcacgcggcatagaggtcgggcatattttcaaactcggcacaaaatacagtgaggccatgcacgccgcctttttagacgaaaacggcagggagcaggtcatgttgatggggtgttacgggattggtgtctcccgcactttaacagcagtgtgcgaacagcataacgatgataaagggcttgtttggcctgtcaatctggcgccgtttgacgtgcatctcgttccggtaaatatgaaggatgcccaacaatccgcccttgcagaatcgctccatgcggaacttgaaaagcagtttaccgtcttgatggatgacagaaacgagcgcccgggtgtgaaatttgcggattccgacctgatcggcctgcctgtccgggtaaccgtcgggaaaaaagcggcggaaggcatcgtcgaagtgaaaatcagaaaaaccggggaagtgctcgaagtgaaaaaagaggatttggccgagacaatttctaatattttagcacaacttgcttcatgacaggggcatcggcttaccggccggtgcttctcttcttttcctgcaaaaaagaggcagaaaatgttttgcctggaaaatttcaacacccgaacctttcaacactaccgggaaaaattccggaaagattgcattcgggacgcttgttttttaagataaagatagattgaatgaaaaaggatgggagaggacaagatgattgaaaatcccgccggaaagaaagaaaggttccagattttgctccggcagctggaactgcttgatgacaggttttacgagcattttaaatacggagaaattgaaaaactagttgtggaacgccagtcaaagcgatggcatttttattttttgctcgaaaaaattctcccctttgaagtgtacttgacatttacaacccgtttgcgccaggcttttcagcatattgccgacgtccgtttttcaatccgggcgaaagacccttcttttgggccggcgctgattgccgattactggaaagcgtgcctaggagaactggaaggcatgtcgccgatgcttttgtccctacttgcggagcaggtgccgtcactttccggcaataagctggtggtaaccggccgcaatgaaccggaagcagcgacattaaaacaaaaatacggggaatggatcgtccgtttttacgaacgggccggttttccgcagctgatgtttgacacggaaatttcggcggcacctgaagcaagtgaagcatacgccaaatttatggaagaaaagaaaaaagaagatgaggaacgggcaaaacaggccgttctcgaaatgcagaagcacgtgaatgagcaacagagcggggaagaaacgcacgacgcgggaccgcttatgatcgggctgagaatcccgcccgatgatgatatccgccgcctttccgagattgttgatgaagaacggcggattacggtggaaggctatgtgtttgacgtcgaaacgaaagaactgcgcagcgggcggacgcttttgacgttaaaaatcaccgattatacgagctccattctcgtgaagatgttttcgcgggataaggaagatgccgcacaatttgcccgcgtgaagaaagggatgtggctgcgtgcgcgcggcagcatccagaacgatacgtttgtccgtgatctggtcatgatcgccaacgatctttctgaagtagccccgcgcgtccggaaagaccatgcgccggaaaatgagaagcgggtcgaactccatctccatacgccgatgagccagatggatgcggtcacttccgcgtctacccttgtcgcccaggcaaaaaaatggggccatccggcgattgcgatcacagaccacgccgtcgcgcaaagttttccggaagcttacagcgccggcaaaaagaacggtataaaagtcatcttcggcgttgaagccaatcttgtcgacgacggggtgccgattgcctataatgatgcgcacgtccaccttgatgaagcgacatatgtcgtctttgacgttgaaacaacgggattatctgccgtttatgatacgatcatcgaaatcgctgcggtgaaaatccaagacggcgaagtggtcgatacgtttgaacggtttgccaatcccggacgtccgctgtccaatacgattattgagctgacccatattaccgacgatatgttaaaagatgcgccggacatttccgaagtgttgaaagaatacaatgaatggattggcgacgcggtgcttgtagcccacaatgcttcgttcgacatcgggtttttaaacgttggcctgaaaaaagccgggctgccgaaatccaataaccccgtcattgatacgctcgaactcggacggtttttatatccggatttcaaaaactaccggctgaacacgctcgcgaaaaaattcaatgtggaactgacccagcaccaccgcgcaatctacgatacggaagcaacaggacaaatctttttaaaaatgctgaaagacgcccgtaaccgggggatcacataccatgacgagctgaaccagtatatgggggaaggcggcgcgtacaagcgggcgcgcccgtcgcactgcacgctgcttgtccggacgcaggaaggcttgaaaaatttatttaaactgatttctctttcccatatcgattacttttaccgtgtgccgcgtattccgcgttccgagctgcaaaagtaccgggaaggcattctcgtcgggtccggctgtgacaaaggcgaagtatttgaaggcatgatgcagaaagatccggcggaagtagaggagatcgcccgcttttatgattatcttgaagtccatccgaaagaagtgtacgccccgctcatcgaccaggaactgataagggatgaaaaggcgcttgaagaaatcatcacgaaaatcgtcaggctcggggaaaaattaaatctgccggttgtcgcaacaggcaatgtccattatttaaaccccgaagacaaaatttaccggaaaatcctgatcagctcccagggcggtgccaatccgctgaaccggcaccggctgccggacgtgcatttccgcacgacggatgaaatgcttgcatgcttctcgtttttaggcgaagaaaaggcaaaagaaatcgtggttgacaacacgaataaaattgccggcttaatcgaggacgtcaagccggtaaaagatgagttgtacacgccgaaaattgaaggggcggaagaagaaatccgcgagcaaagctataagcgcgcgaaaaggatttacggggatccacttcccgaaattgtcgaagcacggcttgaaaaagagctaaaaagcattattggtcacggatttgcggtcatttatctgattgcccataaacttgtcaagaaatcattgaatgacggttaccttgtcggttcgcgggggtctgtcggctcttcgcttgttgcaacgatgacggaaatcaccgaagtcaacccgctcccgccgcattatgtgtgcccgaactgcaagcattccgagtttttcaatgacggttcggtcggttccggttttgacctgccggataaaaactgcccggcgtgcggggcaaaatacaaaaaagacggccatgatattccgtttgaaacgttccttggctttaaaggggacaaggtaccggatattgacctgaacttttcgggcgattaccagccgcgcgcccacgcctatacaaaagtgttgttcggcgaagagtatgtataccgcgccggcacgatcggcacggttgcggaaaaaacggcctacggctatgtaaaagggtatgcccaggaccataatctgacattccggagcgcggaaattgaccggcttgtccagggctgcaccggggtgaaacggacgaccggccagcatccgggtggcattatcgtcgtcccggattatatggatatatacgattttacgccgatccagtatccggcggacgatcacaattcggaatggcggacaacgcattttgatttccactcgatccacgataatattttgaagcttgatatactcgggcacgatgatccgaccgtcatccgcatgctccaggacttaagcgggattgacccgaaaacgatcccgaccgatgacccggaagtgatgaaaattttcagcgggccggaaccgctcggggttacggaagagcagattatgtgcaaaaccggcacgctcggcattccggaatttggcacaaagtttgtgcgccaaatgctcgaagatacaaaaccgacgacttttgccgaactggtccagatttcagggctttcgcacggaacggacgtatggctcggcaacgcccaggaactgatccaaaacggcacatgcaccctgcctgaagtaatcggctgccgggacgatattatggtctatttaatctatcagggcttagagccgtcccttgcttttaaaattatggaatcggtacggaaagggaaagggctcacgcctgaaatggaagaggaaatgatcaagcaaaacgtgccaaattggtatattgaatcgtgcaaaaagattaaatatatgttcccgaaagcccacgccaccgcctatgtgctgatggcggtaaggatcgcttacttcaaggtgtaccatccgctgatctactatgcgacgtattttacggtgcgcgcggaggatttcgatctcgatgtcatgatccacggctcgaattccatcaaggcaaaaatcagtgaaattaatgcaaaagggatggacgcatcggcgaaggagaaaagtttgctgaccgtgctcgaactggcgcttgaaatgacggcgcgcggcttccgcttccagccgattgatttgtatcgatcggaagcagacaagtttgtcattgacggcgattcgctcattccgccgtttaatgcgattccgggtcttggtacaaacgccgcggtcaatatcgtaaaagcgcgtgaagaaggtgaattcctttcaaaagaagacttgcagcgccgcggaaaagtctccaaaacgattatggaataccttgacgggcacggctgcttagagtcgctgccggagcagaaccagctgtcgcttttctaaatacgggttaaggaccgctgtttgcttttttttgcctgttatggtatagttttttatggaaatactatggataaacgctcgtgcgaaagagtggggccatcaccccgctctttcgtgttttaaatcggatttttgaggaggtcagcatgagtaaagtcgttgaagtggtggaacaactggcatccccggttgtggaagggctcggccttgaacttgttgatattgaatacgtcaaagaaggaaaaaactggtttcttcgtgtttatattgacaaagaaaacggggtcgatatcgaagaatgcgggctcgtcagcgaacggctcggggaaaagctcgatgaagcggacccgattccccataattatttccttgaggtttcctccccgggtgcggaacgcccgttaaaaaaagcgcgtgactttgaacgtgctgtcggccggaccgtcctcgtgaaaacgtatgaaccgcttgacggggagaaaacgttccagggaaaattgattgcttttcacaacgggtgcctaacattagaatgtaaagtgaaaacgaagaaaatcgagaaggaaattccgtatgacaaagtggccaacgcacggcttgccgttgaattttaaaaatgcatcatttttcaaaaaatgaagggggatccaatttccatgagctcagaactggtagatgcgcttacgatacttgaagaagaaaaaggaatttcgcgggatgtgctcgttgaagccatcgaagccgcgcttgtatcggcataccgccgcaattttaaccaggcacagaatgtaaggacggatttaaatctggcgaacgggacgatccgtgtgttcgcgcgtaaagacgtggttgaagaagtatttgacccgcgccttgaaatttcgcttgaagatgcccagaaaatcaatccgtcttatgaaatcggcgatgttgtcgaattggaagtcacgccgaaagattttggccggatcgccgcacagacagcaaaacaggttgtcacgcagcgcgtccgggaagcggaacggggaatcatttacaatcaatttatcgaccgtgaagacgaggtcatgaccgggattgtgcagcggaaagatccgcgttttacgtatgtcagcctcggaaaaacagaagcactgctgccgccgggggaacaatccccgaatgaaacgtacaacccgcatgaccggattaaggtctacattacaaaagtcgaacggacaacaaaggggccgcaaatttttgtctcgcgcacccatcccggccttttaaaacggctgtttgaacttgaagtgccggaaatttacgatggcatcgtagaaatccgttcgatcgcccgcgaagcaggggaccgttcgaaaatttcggtttacaccgaccgcccggaggttgatcctgtcggcgcatgcgtcgggcctaaagggcagcgcgtccaggcgattgtaaatgaacttcacggggaaaagattgatattgtaaaatggtcggacgacccggctaaatttgtagcaaatgcgttaagccctgcaaaagtgcttgatgtgcttgttgacgaaaacaataaggctacaacggtcatcgttccggattaccagctgtcgcttgcaatcgggaaacgcggccaaaacgcccggcttgccgcgaaactcacaggctggaaaattgatattaagagcgaaacggatgcaagggagtcaggcatttatccgcgttctgaaaccaatgatgacataggcggggaaacaccggggctttttgatgacgatgatgccggccgcacttccgaagcactggccgtaccggatgcgaaagaagcggatctgcctgaaaacggcgggaaagatgaagagatcgaataaggagtggggctgatggcgacacgtaagaaaattccgatgagaaaatgcgtagcaacgggagaaatgaaaccgaaaaaagaaatggtccgtatcgtccgttccaaggaaggcgatgtttcgattgacccgaccgggaaaaagtcaggaagaggcgcctatctttcaaaagacgaagaagcggtgctgttggcaaagaaaaaaaatattctctcatcccatcttggtgccgctgtagaagatgctttttatgatgaaatcatcgcgtttattcaaaaggaaaaaaaggagaataaacaaaaatcatgaacgggaagcaggcaatgtcccttttaggccttgcgttcaaggcaggaaagatcgtttcgggagaggagcctgtcctgaaagaaatccgggcaggccaggcaaaacttgtattgctttcaaaagatgcctcatccaatacgtcaaaaaaaatgttagacaaatgccgtttctatcatgtaccggtacggtggatagagacgagggaaatgcttggaaaagccattgggaaagaggcgagagtcgcagttgccgtaagtgaccgcggatttgcggaaaaacttgctgaactgctcgatgaatcataggtgggggtgacgacatgagcaaaatacgtgtttacgaatatgcgaaagctcatcatacatcaagtaaggaaattatcacgaaactaaaacaaatgaatatagaggtatccaatcatatgtcaatgatcgatggggaaacagtaaggaagctggatacggtttacagcggcaaaaatcagcaggatggcaagaaaaacgggcaaaacgggccgaccagaaatgaaagaagcaccaggtccgaaaccggggaccgacaaggaaacaaacccgaaaaccgcacccggcgcgaaaaccagaagccgaatcacggaaacggccaaaacagcaaaaaccaaggggataacggaaacagcagaaacaataacaataaccgctctggcggcagcaaccgcagcgatgggaagagcagaacgggcggcaacaatcggaataacaggaacggccaaaccggcggcaacaaccggagcaatggaaacacccaggccgcaagcaacaaccggaataacgaaaaaagccaggctgcaagtaacaaccggaataacggaaacagccagaacacaagcaacaaccggagcaatggaaacacccaagccgcgggcaacaacaggaataatcaaaacagcgggaacagccggaacaacgggaataaccgcaacagtggcaatggaaaccgtagcaataacggaaaccgcggcaacaacggacggccgtttaacaaacaaaagaaaaataaccggaaaaataaaaacttcaaaccgcagccgcagccggtccaaaaggtaaaagaactgcctgaaaaaattacgttcacagaatcgctgaccgttgcggaacttgcgaagaagctctacagggaaccttccgaaattattaaaaaactgttcctgctcggcgttgcggcaacgatcaaccagcagcttgacaaagacgccattgaactgattgcttcggaatacggcgttgaagtggaagaaaaagtgatcgttgaccagacggatctggaaacgtattttacggaagaccgtgaagaagacctcgaagtccgcccgccggttgtcaccattatgggccatgttgaccatgggaaaacgacaacgctcgattccatccgccatacaaaagtcaccgccggagaagcaggcgggattacccagcatatcggtgcataccaggtgaaagtaggcggcaaaaaaattacatttttagacacgccggggcatgaagcctttacaacaatgcgtgcgcggggggcgcaagtgacggacattaccgtgcttgttgttgctgccgatgacggcgtgaagccgcagacagtggaagccattaaccacgcgaaagcagccggcgttccgatcattgttgcggtcaataaaattgataaaccgacagcgaaccccgaacgagtcatgcaggaactgacggaatacaatctggttccggaagactggggcggggatacgatttttgtcccgatttctgctctaaccggtgaagggattgacaatctgcttgaaatgattttgcttgtcagcgaagtggaagaactgaaagcaaacccgaaccgccgcgcactcggttcggttattgaagcgcgccttgataaaggcaggggcccggttgccactttgctcgtacaaaacggcactttgcgcatcggcgacccgattgtagtcggtcacacttacgggcgcgtccgtgcgatggtcaatgatctcggccgtcgcgtgaaagaagcagggccgtccacgcctgttgaaattaccggtttaaatgatgtaccggaagccggcgaccgttttgttgtctttgaagatgagaaaacagcccgccaggtcggggaagcgcggaaacaacaggctgtccaggcgcaccgtaacgaaaccgcgcgcgtcagccttgacacgttgtttgagcaaatgaagcaaggggaaatgaaagaattaaatgtgattgtcaaagcggatgtgcaaggctctgtagaagcattgaccgccgctttgcaaaagattgatgtggagggcgtcaacattaacgttatccatacgggcgtcggcgcgattaatgaatccgatgtgacgcttgcttccgcttcgaatgcgattattattggctttaatgtccgcccggataataacgccaaacgcgcagccgaaacggaaaaagtggatatccgcctgcaccgcattatctacaaagcgatcgaagaaatcgaatctgccatgaaagggatgcttgatccggaatacaaagaaaaaatcatcggccaggttgaagtgcggcagacgtttaaagtatcacggatcggcacgattgcgggcggctatgtcaccgacggaaaaatcacccgtgacagcggcgtgcgcgtcatccgtgacggcgtggtcatttatgaaggtgtaattgatacgctgaaacgctataaagatgatgtgaaagaagtcaaccagggatatgaatgcgggattacgattaaaaactttaatgacatcaaagaaggagatgtcatcgagtcctttatcatggaggaaattgaaagagcatgattgggagcgcccgttgcgaatttcgcatttatgatgcccgttcattgaaagaaaaaagggcagtgctgcaaagaatattgacgcggctaaagcaaaaatataatgttgcagccggtgaaatggatttccaggatgcctggcagcggaccctcgttgaagtcgtgaccgttgcttcaagccgggcggcggctgaaagagaattgcagcgggcaattctctttctggattccttccctgaatgggagcgtcttgaaacaaatattgaatggctataaatgaggtgtgattgatgaatcttcgtgcaaatagggttggcgagcaaatgaaaaaagagctgagcgacattatcgggcgaaaactaaaagatccgcgtgtcggctttgtcactgtaaccgatgtggaagtaacaggcgatcttcagcaggcaaaagtgtacctcaccgtcctcggcgatgaggtacaaaagaaagacacccttgacggcctggaaaaagcaaaaggctttatccgctcggaagttggcaaaaggatccggctccgcaaaacgcctgaactgatttttgaaatcgatgaatccatcgaatacggcaaccgcattgagacgctgatcaaaaaaatccatgacacggatgaatgaatgtttcaggaaactgatcggagccggaacacggttcggtaagtttcctttttttgagtgattctattggatttgcgaaaggaagtggcgccatggatggcattttaccgctctggaaaccggcggggatgacttcccatgactgtgtttttaaaatccggaagcttttcggcacaaaaaaagcaggccataccggcacgcttgatccggatgtggaaggggtcctcccggtttgcatcgggcgtgcgacaaagattgccgaataccttcaggatgccggcaaaacttacgaaggtgaagcaacgatcgggatttcaacgacgacagaagatgcttccggcgatatcattgaaaaaaaggaaattagccggccgatcagccgggaagaaattttagccgcactcgcttcgtttaccgggcatattacccagatcccgccgatgttttccgccgtcaaggtgaacggaagaaggttgtatgaatatgcgcgggcgggcatcgaagtggaacgccctaaaaggaatgtgcaaatttacagccttgaactattggacgggcgggaatattttgaagggccggttgtgtcgttccgtttccgcgcttcatgcagcaaaggcacctatatccgcacgcttgctgttatgatcggagaaaagctcggctatccggcacatatgtccaatcttacaagaattgaagcaggcggtttttcaaaggaacaatgcgccacctttcaggagattgaaaaagccgcggaaaccggcgacagggaaagcctgctctacccgctcgaggccgggatccgccatttgccgaaatgggaaattagtgatacattagcagagaaagtaaagaacggtgccgtgttgaaaaaaccggagacctggccggaaacaggagacaggcttgctgtctttttccgcggaaaaatactcgcggtatacgtggcgcattccggcaggcccggctttatcaaaccggcgaaagtgatataaaaagccttccgggtataaaacaaggaaggcggctgcttcaatttgtaaaagggaaaaggtgagaaattttgaaaacaataacggtccatcatccccattcctttaaacccggcgattttccgccgcttgccatcgcattgggttattttgacggcatccatctcggacatcagaaagtgattaaaacagcccgcgggatcgctgaaaaaaacggatggaaaagcgccgtcatgacatttgaaccccatccttctattgtgctgggaaagaaaaaggatggcattgaactgattacaccgcttgaagacaagatcaagttgattgaaaaacttggtgtcgattatctgttcgtcgtccgttttacctcccgttttgcgtctcttttgccgcagcaatttgtcgaccaatatctggccgcactcggtgtgaaacatgttgttgctggttttgattatacatacggcaaattcgggaaaggcaatatggagaatctccctgaatatgcaaacggcaggttcgggattacggtgattgaaaaactggcccttgaaaataccggggaaaaagtcagctccaccctgatccggtcaaaaatcagggaaggaaaagtcggggaagtgaagccgctgctcgggcgcgattatgagatcaaaggcattgtcgtccatggggagaagcggggacgacagctcgggtttccaacggcaaatctaaagcttaccgcgtcgtatatgctgccgccaaacggggtatacattgtgcaaatgaaggtcgcggatacgtggcataacggcttatgcagcattggctacaatcctacgtttaaaaatccggaagaatatgaaaaaacgacagaagtgtatctgcttgatttttccgataccatttacggggaagaagcagttgtcaaatggcttgcgcgcatccgcgaagagaaaaagttcgcccgcgtggaggacttgattgaagaaatgaaacgggatgaaacggcagcaaggcgttactttgaaaaacagggaactgctacttgagttttgtgcgaaaaagtagtattctattacagtaccggaacctgtgcttggcagcgcgactcaccgacgcctgctcggcaacaggggataggaaacagaggaggtgaacaggatggcgatttcaaaagaacgtaaaaatgaaatcatcaaccaatttaaaatccacgagaacgataccggttctccggaagtgcaaattgctgtattgacagaagaaatcaacaaattgaacgatcatttgcgtgtccataaaaaagaccaccattcacgccgcggcttgatgaaaatggtagggagacggcgtaatttgttgacctatctgcgcaataaagatgtgcatcgttaccgtgaattgattaaccggctgggcttgcgccgataaaaaaatgcagaatgcaaaaagcgggagtattcccgcttttttgcaatgtgtttttccccccttaattttgggaacagatgtatttcaaattgccgccgggttttcgcactgacctggcgcggcttgtacatacatagcaaacggttgattcgtttttgaatcattacccgtgcttatctttgaataaatgtgaaacaatataggcaaaaagaaaggagattttcatctgtatggtacaggataaacatacctatacgatagattgggccggccgcccgctcaccgtggagatcggccagctcgcaaaacaggcaaacggtgctgcactcgtccgttacggcgaaacggctgtcctcagtacagcaaccgcttctaaagaaccgaaaaatgtggacttttttccactgaccgtaaattatgaggaacggctatatgctgtcgggaaaattccgggcggctttatcaaaagagaagggcgcccgagcgaaaaagccattttgtcaagtcggctgattgacaggccgatccgcccgctctttgccgacggcttccgcaatgaagtgcaggttgtcagtatggtcatgagcgtcgaccaggactgcacgccggaaatggccgcgatgctcgggtcttcgctcgcactttccgtctccgatattccgtttgaaggcccgattgccggcgtcatcgtcggaagggtggacggcaagttcctcatcaacccgaccgtggaacagatggaaaaaagcgacatccatttaaccgttgccggcacaaaagacgccattaatatggttgaagcgggtgcgaaagaagtgccggaagaagtgatgcttgaagcgatcatgttcgggcatgaggaaatcaagcgcctgattgctttccaggaaaaaattgtggcagaaatcggaaaagagaaaatggctgttgaattgttcgaacttgacgaagaactggtggaaaaagtcagcggcatgtgccggaaaaaaatgattgaagccatccaggttcatgagaagaaagcgcgcgaagaagcgatcagaaaagtgggcgatgaggtgcttgcccaatttgaagcagaagaagccgatgaagaaacggtcaagcaggttaaacaaattttgcacgatattgaaaaagaagaagtccgcaagctgatcacggtcgataaaattcgcccggacggccgcaaaatcgatgaaatccggccgctttcctccgaagtcggggttttgccgcgcacgcacggttccgggttgtttacccgcgggcaaacacaggctttaagcatttgtacgttaggcgctttaggcgacgtgcaaattttggacgggctcggcattgaagagtcaaaacggtttatgcaccattacaatttcccttcattcagcgtcggggaaaccgggccaatgagagggccgggccgccgcgaaatcgggcacggggcactgggtgaacgtgcgctggaaccggtcattccggatgaaaaagaatttccgtacacgatccggcttgtatccgaggtgctcgaatcgaacggctccacttcacaggcaagcatttgcgcatccacccttgccatgatggatgccggcattccgattaaagcgccggttgctgggattgcgatggggcttgtgaaatccggcgaacattatacgattttaaccgatatccagggcatggaagaccatctcggcgatatggactttaaagtggccggcacgtcgaagggcgtcaccgcgctgcaaatggatattaaaattgcaggactgtcaagggagatactggaagaagcgttgcagcaggcgagaaagggcagaatgcagattctcgaccatatgatgtcgacgatttcgaaaacacgtgaccatttgtccgtctatgcgccgaagattttaacgatgaccattcatccggataaaatccgcgacgtcatcgggccaagcggtaaacaaatcaataaaatcattgacgaaaccggcgtgaaaattgacattgaacaggatggcaccatctttatttcttcgacggacgaagaggcaaacaacaaagcgaagaaattgattgaggatattgtccgggaagtcgaagtcggcaaggtttatctcggtaaagtaaaacggatcgaaaaatttggcgcttttgtggaaatctttaacggcaaagacggccttgtccacatttccgaactcgccgaagaacgcgtccggaaagtcgaagatgttgtcaaaatcggcgatgaaattctggtcaaagtgacggatattgacagccacgggcgcatcaacctttcccgcaaagctgttttaaaggagcagcaaaaaaaaagaaaataaatcgtgatgaaagtcagggagccctggctttttttatttgtcccgcgcgcccgttctatgcccctttcccttttcatactttttttaaagaagggggaaaataacgtgaataaagcaaaacgcttgattgcgcttggcttgattgctattctagcattgttgcttgcgggaaatccgctttccacccggtatttgcaggagcgggccgcctttagcacaaaagagaacgagcttcaggaaaaaattgaacaggctgcagaacggttttaccgtccgccggaaaatgccaagattgacagggtttggaaggcgatccccggctataacggggtggaagtggacaaaaaagcttcttactcgaaaatgaaacaggacggccgttacgacgaacgcaaactggtatttaaacaaattccccctgccgtccaccttaaagatctggacccggcccccgtctatacgggaaatccggataaaccaatggttgcttttttaatcaatgtcgcatgggggaatgaatatttgccggatatgctaaaaactttaaaaaagcatcatcttcatgctacctttttcttagaggggcgatgggcaaaagaaaaccctgagcttgcccgcatgattgtaagcggcgggcatgaaaccgggaaccattcctatacccaccccgattttagcactttgccggaatcaaagatcaaaagccagctggtgaagacaaaccgggtgcttgaagcgattacggaagaaaaagtgaagtggtttgccccgccaagcggcagttaccgggatgaagcggtaagcatcgcaaaatcaatgggaatggaaacgatcatgtggacggtcgatacggtcgactggcagaacccctccccggagacgattgtagagcgcgtgactgcgaaagcacagggcggttcgcttattttaatgcatccgaccgcttctacagcgaaagcgttggaaccgttgattgccaggctggaaaagaaaaatttacaagtcggaaccgtttcaaaattgctcgatgaggaaagaatcattaaaaatgaggacggaacatttttaaacagcgaaaaggatcccgctgatacaaaagacggcacagagtgaaatgagactgcgaggaggcacaacatgatacaaaaatatacttgccataacggcttgaggattgtactggaagaaattccaactgtccgttcggttgcgatcggcatttggatcggcaccggttcgagaaatgaaaatgaaaaaaacaatggcatttcccattttcttgagcatatgtttttcaaagggacggaaaaaaggagcgcaaaagacattgccgaggcctttgatgccattggcggccaggtgaatgcttttacgtcgaaagaatatacatgcttttatgcgaaagtgctcgacacgcatgcaccgctcgcgcttgaaattctgtcggacatgtttttccactccactttttcagaagatgaaatggaacgcgaaaaaagcgttgtcaatgaagaaatcaaaatgtatgaagatacgccggacgatattgtccacgatttgcttggcaaggccatttatgaaaaccatccgctcggctatccgattttagggacggaagaaacgcttgcatcgtttacgagcgacgatctccatcagtatgtatatgatatgtatacccctgaccgcgttgtcgtctccgttgccggcaatgtgccgccgtctttcgtaagggagattgaagccttgttcggctcctatgaaggcgggaaggcagagacgggcggcgaaacggccgtttttcatacgaatgaccttgcacgcaaaaaagaaacagaacaggcccatctctgcctcggatttgagggggagaaaatcggcagtgacgatatttatgagctgattgtcctgaataatatattaggcggcagcatgtcctcccgccttttccaaaatgtgcgggaacagcgggggcttgcatattcggtgtattcctaccataccgcctataaggacagcggcattttaacgatttacggcggaacgggcgcctcccaattggacgagctgtttgagacggtacaggagacgctgcagacgctgaaagcaaaaggggtaacagaaaaagaagtgcgaaactgcaaagaacagttaaaagggagcctcatgctcagcctggagagcacaaacagccgcatgagccggaacggaaagaacgaactgctgttaaagaagcaccgttcgcttgatgaaatgctcgaggaaatcgaccgcgtcaccgtggaaaaagtcaatgcctgtgcgcgggagattttctccaaaccgtattcggcctctttaatcagcccggacggaaaattgccggagcggttgtcttaaaaacggcatatcttttccatcccccgcataaaatggaatcagtccatgagagaaagaagggggaatatgcggctcagcgaactcagcggaaaagaaatggtcgattttaaaaaagcggaacggctcggggtattgggctccacggaccttgaaattgatgaagcgagcggaaaagtggaggccctgatcatcccggtcggaaggcggtttaaaaaacaggcgaacgagatccgtgtcccgtggaaccggatcagaacgattggtgccgatatgatgattttggaagtgcctgaaaaccagtacagctattaaaaaggcaaagaagcatgccgggtattccggcatttttctttgccttttttcacaaaaaacatgctgccgccataagatatggggaatcccccatgcacatggaaaagaaggtgaggcatttgttgaccggcgtccaaattgccatcataggcggagatgcacgccagctggaagtgatccggaaacttgcggatctcgatgcgaaaatttcattgatcggatttgaacagctcgattttgtgtattccggcgtcacgaaagaaaaatttaaagatatccggttttcggaaatggattgcgtcattttgccgattaccgggacagcggacgacgggaaaatcgatttgattttttcgaacgaagaagttgtgctgaccggtgatatgctggctgaaacgccgccttattttacgatctataccggcatcagcaatccgtatttggaacaaattgctaaaaaagcgggccgccgccttgtgaaactattcgagcgggacgatgtggccatctataattcgattccgaccgtcgaaggaacgatcatgatggctattcagaacacggaatttacgattcacggctcaaatgttgccgtcctcggccttggcagggtgggaatgagcgttgcccgggctttctgccatctcggcgcgaaggtgaaagtcggcgcgagaaaaagcgaacatcttgcgaggataacggagatggggcttgtgccttttcatttaaacgatcttgaacaggaagtaaaagacattgacatctgcattaatacggttccgcacctgattgtgaacgcatccgttatccaaaagatgccttcgcatacgctcattctggatattgcttccaaaccgggcggaacggatttccggtatgccgaaaagcgcggcattaaagcgatgctggcgccgagcctgcctggcattgtcgcgccgaaaacagccgggcggatactcgggaatgtgctcggccggctgattgaagaagacgttttaaaaagaaaggggtcatcgccatggatgtaaagggaaaaagaatcggcttcggcttaaccggctcccattgcacttatgcggccgtttttcctgaaatcgaaaagctcgtggcattgggggcggaagtcatcccggtggtcacgcacacggtgaaaacgacggatacaagattcggcaaaggctcagaatgggtggaaaaaattgaaaaatgcaccgggcaaaaagcgattgattcgattgtcgaggccgagccgctcgggccaaccctcccgcttgactgcatggtgattgcgcccctgaccggatttacgatgagcaaactggcgaacgcgctcacggattccccggtgctgatggccgccaaagcgacgctccgcaatttgaaaccggttgtgctcggcatttcgaccaatgatgcgctcggattaaacggcgtgaatttgatgcggctgatggcaacaaaaaacatttattttattccgtacgggcaggacgacccggacaacaaaccaaattcaatggtggcgagaatgactgcccttgccgatacggtttcgcttgcactcgaggggaaacaaatccagcctgtcattgtcgaacgtttccgcgacggaaaatcgccttgaaaacgatttaaaattaaaaaatacacacggtgccggaagacttgtgatacaataatagctataaaaatgaatttggttttggaattggaaggggaatacgccaatggcaaacacatcaggttatcacgtagccgttgtcggggcaaccggcgctgtcggccagcaaatgattaaaactttggtaaaccgcaaatttccgtataacaaattgacgctgctgtcatcttcgcgttccgccggcaaaaaaataacggtaaacggggaagaaattacggtccaagaagcggtgccggaaagctttgaaggagtggatatcgcccttttcagcgcaggcgggagcgtgtcgaaaaagtttgcgccggaagcggtgaaacgcggggcaattgtcattgacaatacgagcgccttccgcatggacccagaagtgccgcttgtggtcccggaagtaaacgaagaagacattcaaaaacataacggcatcatcgccaatccgaactgctcgacgatccagatggttgttgcgttggaacccgtccgcaaaaatttcggcctgaagcgggtgctcgtttccacgtaccaggctgtctccggttcgggcgcggctgccatccaggagctgaacgacgagacgaaggcgttgcttgaagggcagacttacgagccgcatgtactgccggtaaaaggtgacaaaaagcattaccagattgcgtttaatgccatcccgcaaatcgatgtgtttacggacaacggctttacatttgaagaaatgaaaatgatcaacgaaacgaaaaaaatcatgcatatgccggaattaaaagtttccgccacatgcgtccggattccggttgcaaccggccactcggaatcggtttattttgaaaccgaaaaggacggcataaatgctgggcagatccgggaagtgctcgcgtctgcacctggtgttgtactggaagaccgccccgaagaacagatttacccgatggccgtcaatgcggtcggcaagtatgacacttttgtcgggcggatccgcaaagacccggatgaagacaacggattccatatgtgggttgtttccgacaatttgctgaaaggcgctgcctcaaattccatccagattgcggaaagcctgatcaggatggggctcatctgatttgtggacaatttaggctgacctttttgcaatattggtgataagatatagggaaagaaaagttatgccggaatccggtatcggagagggttccatttcctgatatattttatggacacgtatgccgtttcctttccggccgggaaggaaacggtttaaaaacggccggcccttaaaacggcctttggcaaaaaaacggccggcaaagcccgcacgttaccggaatcactgttcttatttatcagttcataacagaggtgttcttcattgaaaatcgttgtccaaaaattcggcggcacatccgtacgggatcatgatgcaagaatgcatgccaaacatcatgtagaaaaagcgctggaagaaggctataaggtggttgccgtcgtttcggcgatgggtcgcaaaggggaaccgtatgcaacagatacgctcctgtcactcgttggcggatccgacacctgtttaagcaggcgtgagcaggatttactgttgtcaaccggcgaaatcatctccagccttgtgtttgccaatatgttaaacgcacacggcatcagtgcgtgtgccctgaccggtgcgcaagccggtttccacacgaacgcggagcataccaatgcgaaaatcacggacatgaagtgcgaccgtgtcctgcgtgaactgaaactgcacgatgttgtcgtcgttgcaggatttcaaggagccgcaaaaaacggggacgtcaccacgctcggacgcgggggcagtgacacatccgctgcggcgctcggtgctgcgcttcaggcggagtggattgatatttttaccgatgtggaaggcatcatgacagctgacccgcggattgctgaaaatgcgcggaagcttcaggttgtcacgtataacgaggtctgcaatatggcttatcagggcgcaaaagtgatccatccgcgcgccgttgaaatcgcgatgcagtcgaaagtgccgatccgcatccggtccacttattccgacgatatcggtacgcttgtcacatctttaagccaccgtcagaaactcgggaccgatataaaagaacgcactgttaccggaattgcgcatgtaccgaatgtttcacagatcaaagtatatgcaaaagacgggcagtatgatttgcagacggttgtgtttaaagcgatggctgctgaaaatatcagtgtcgattttatcaatatttccccgacaagcgttgtctacacggtttcaggagaggtggcaaaccgggctgaagcggtgctgaaaaaactggggcatgaaccggtaattgaacggaactgcgccaaagtatcgattgtcggcgccgggattgcgggcgtgccgggtatcacgtataaaatcgtgtcggcgctttccgaaaaagggatccggattttacagtctgctgacagccatacaaccatctgggtgcttgtgaagcaggaagatctggttacagcggtcaatgcccttcatgatgcctttaatttagaaagcgaaacggaaacgtatgaaattcatgcgtaaaaaatgaaagattttctgccgggtgttttcaccttgcaacttgcaaaacctggcaggatgaggagtgtaagtatgagtcgtttcggaaaagtttcaacggcaatggtgacgccttttgaccataaagggaatctggatttgcaaaaggcggcaaagctggttgattatttaattgaaaacggaacagaatctttggttgttgctggaacaacgggggaatccccgacactttcgcctgaggaaaaaaccgcgctgttcaagcaggttgtgaaaacgtcagacgggcgggtaccggtcattgccggaacagggagcaacaatacgtatgcttcgatcgaattgacgaagcgtgcggaatcatgcggcgtggatgccgttatggctgtcggcccgtattataacaagccgaaccaggctggcatgtatgcccatttcaaagcgattgcagaatccacgagcctcccggttgtcatttacaacatccctggccggtcggctgtcaatattgaaccgggaacgatcatcgaactttccaaaatcccgaatatcgttgcggtaaaagaagcaagcggggatttggatgcgatggcgcaaattattgcccgtacgccggatgattttgaattgtacagcggggatgatggcctgacaattcccgtgctttcaatcggtggggcgggtgtgatttcggttgcttcccatgttgccggcccggccctacaggaaatggtgcaagccttttttgccggggatgtaacaaaagcggcaaaactgcatcaaaagctgcttccattgatgcgcggcctgtttatggcgcctaatccggcaccggtcaaaaccgctttgcaattaaaagggatggatgtcggcggcgtccgcctcccgctcgttccgttaacaaaagaagaacgggaaaccattcaccgcctgcttggcgatctttaagcaaaaaaacggcccttccggaaaaacggacagggccgttttcttttgcttaagtgatcccataccggcttcgggaaaggaaaacaggccccgtttctgcgaatcttccggcaaacagcagatagcggaaatgggcagcatttgtcgatagaaatatcacacgctcttcattgaccggatatacccttttcggttaagctatacataagagaaaggatcggacagcaatttatttttacgggctcagaaagtctttttcgatagaaccggaacggtgcaagtgatcgtgcgggcgcctcatgccaggcatgacgtttttaaagggatgcggtgggagagccggccgcttatttttatgccggaaacttgaatatgcgcaaagccgtatcggacggaatccggcaaccctttgcgatctatcaaaaagaaacgtgattcctgctctagaatttcagacaacacgggaggaaaagaattttgcgtaaggaaaaaaacgaaaccattaaggtcattcctttaggaggaattggtgaaatcggaaagaatatgtacgtggtggaaaccggagaggatctgtttgtgctcgatgccgggctgatgctaccggaagacgaaatgctcgggatcgatatcgtcatcccggattttacttatttaatggaaaacaggcagcggataaaagggattttcctgacacacgggcatgaggacgcgattggcgccctgccgtatatcctgatgaaactgaacgtgccggtgtatgccacaaagtttaccgtcgcgctggcgaaagaaaaattgaaggaattaaaagtgaaaaagcatatccgctttacggaaatcaatgccgacacggttctccattttgatgcttgcgatattcactttttcaaaacaacgcatagcattcccgactcggtcggcatttgcatttccacaccgaaaggcaatattgtgtataccggcgattttaaatttgaccaggaactgggcgggcattatcgttcagaaatcggaaaaatgtcgaaaatcggtgaagaaggcgtgctcctgttactatccgacagcacggaagcggaacatccaggctacacgacccatgagtctgttgtggcggaagaaataacggatgctttctacgatgcgaagggccggattattatcgcaagctttgcctcgaatttaatcagggtgcagcaagtgctcgatgcggcttctgctaccggccgcaaagttgcgtttgtcggaaattatcttgaaaaaatatataaaattgcattaaaattgggatacttgcaggctcggacagaggatctcatcatcccgctgcaacaaatttcaaaataccgggacgaagaactggcgattttgacaacagggagccagggggaaccgtttctcgtcctccagaaaatggcgaaaaagaaccataagcaggtcaatattcaaaaaggggatacggttatccttgccacaacgccgtctccggggctggaactgttcatggcgaaaacgatcgacatgctgtaccgtgcaggagccgatgtttacgcgggcgaccggaaaattcatgtgaccggccacggctgccaggaagatttaaagctgatgcttgatttaatgaggcctaaatactttgtcccgatccagggggaatacaggagcctgtatgcccatgcaaaactggcgtacaaaacggggatgccgaaagagtcagtcatcatctccagcaacggggaagtattggaatacaagcacggcaaattccaagcgagcagccgggttgcttccggcaatattctcattgacggaatcggcgttggcgatgtcggcaatattgtattgcgggatcgaaaacttttaagccaggacgggatattggttgtcgtcgtcacgcttgataaaaagcataaaaaactggctgctggccctgaaattatctcgcgcgggttcgtctatgtacgcgaatccgaaaagctgatcagccattcgtccaacatcgtaaaagaagtggtggagcagaacacgtcacaggaagcttttgactggacgagtattaaacaggggatccgcgaccatctcagctcctttttatatgagcagacgaaaaggcgcccgatgatcctgccaattattatggaagtttgatgcttaaacgacagagggcggggcgggggttcccgcgtgcccgcgctcattgcggcacaaggcccgcctggtgcaccattaaaaatgcaaagcaaagccccgcttccggttccggaaaccgcggggcttccgtatgaaaaccccttccatgcaaataataaggcgtaaaggcgtcacgcccttacattacaggcaaaaaggggttttagaaaaatgagcgaccagcaaccgaataaagaagaaccgaaagaaggaaatgcggcatccgcgcttgtagagaaaatccagcagctcggccagacaaatgtgccgcagctcgggcaggactccaatatccactgcctggccatcgtcggccagattgaaggacatctgcagctgccgccccaaaataaaacgacaaagtatgagcatatgatcccccagcttgtggcgattgaacaaaatccgaaaattgaaggggtgctcgtcattctgaacacggtcggaggggacgtggaggccgggcttgccatttccgaaatgcttgcttccctttccaaacccactgtttcgattgtgctcggcggggggcattccatcggcgtgccgatcgctgtatcctgttcgtattcctttattgctgaaaccgcgacgatgacgattcatccgatccggctcacaggccttgtcattggcgtcccgcaaacgtttgaatatctggataaaatgcaggaacgggtgatcaagtttgtgacgcggcattcgcatgtggaagaagaggtttttaaagacttaatgtttgcgaaagggaatttgacaagggatatcggcaccaatattgtcggtcaggaagccgtccagtacggtttgattgatgaagtgggcgggattggcaaagcgcttggcaaattaaacagcctcattgaaaaataccgggatgaaaaagggaaagaggggctgatccaatgattctctatacgatgatgccgcaggagctgatttttcctgaagatgcaaacgcctggaataaaattaaaatgttaaacgtaaaaggcgtgccggtactggcagagcagcttgatgaagggtaccggattacccgcattctcagctccaatcctttcgactatctgaatccggagcttgcacccggaaatgtgatccgccatttcggaccgtaaaccacccgggccgcaaatatgctataatatgttaaaacaagcagccacacaggctgctttcttgcatcccgttccggcaggcaagactgaaaaatacgttttcactatcgaaggtggttatatggcgaaaaaaaagcggcgcagaagaaaaaaagctgctgaaaaaatcaagatagatttaaagtttgagctgctcggtatcatcctgcttacgctcggcatttttaccctttaccatatcggcaaaacgggcacaaccctgattctgttcttccggtttttcttcggccggctgtactgggttgcggttgcctctctggtcgtgctcagcgtttttctcatgattaaacgggcatggcctgcatttttcactgtccgcatgaccggtttttatttattatttgcgagcgccctcctatactgccatgagcggcttatcgggtcattggcaaatgcgcatgaactgtccggcaacagcgcggtcgaaaatacgatcaggatctggcatcaggaagagcagatctggtggaagcttgtgctcggcggggatgtgcacggcaatattttcagtacgcagatcggcggcggcatggcaggtgcaattttgtatgcggcctcccattttttatttgactcggcgggtacgaaaatcatttgcgttttactcgcgctcatcgctctgatgcttttaacgggcaagcctgtaagcccgtatgtggaaaaggcattggaagggctctggctgtttttaaaaaagcaatggaaccagatgaaaacagagttccaggcatggcgggaagccaaaaaagaaaaacaggaaaagaaacggcagaaagcgccgtcgcagccgcaatccgcctccgcagacggggaagtcagcgacggggatgccggaccggcaggcgaggaaacgcctcccccgattatttccagctttacggagcagtatgccggcacggctccgcaagcggaagaagcgcagccggaaacgccggatacagaagcggaagaggaccatacgcctccgatccagtttacggaatatgaaaatgaagactatcaattgccgcccctgacgctgttaaataggccgcgggcagcggaccagagcagcgaatataaagcaatccatgccaatgcggcaaaactcgaacggactttccaaagcttcggggttaaggcgcgtgtaacacaggtgcatttagggcctgccgttacaaaatacgaagtgcaccctgatgtcggcgtgaaagtcagcaagattgtcagtttaagtgacgacattgcccttgcgctggcggcgaaagatattcggatggaagcgccgatcccgggaaaatcagcgatcggcatcgaagtcccgaataaggaaatcgcggtcgtatcgctcagggaagtgcttgaaggaaaggaaaataacccgcaggcaaaactgcagatcgggctgggccgggatattacagggcaggcggtactcgcagagctgaataaaatgcctcacctgcttgtggccggcgcaacggggagcgggaaaagcgtgtgcattaacgggatcattacgagcatcttaatgcgcgccaaaccgcatgaagtgaaaatgatgatgattgacccgaaaatggtcgaattgaatgtttataacggtgtcccgcatttgcttgcaccggttgtgaccaatccgaaaaaagcttcccaggcgctgaaaaaagtcgtgaatgagatggagcggaggtatgagcttttttcccataccggcacacgcaacatcgaaggatacaacgatcatattaaaaaaagcaacatcgaaacaggggacaagcagccgcttttgccttatatcgttgtcattatcgatgagcttgccgatttaatgatggtggcaagcggcgatgtggaagattccattacgcggctgtcgcaaatggcgcgggcggcaggtattcatctgattattgccacgcaacggccgtctgttgatgtcattaccggtgtcattaaagcgaacatcccgtcaagaatcgcttttgccgtgtcttcggcgactgactcgagaacgattttggatacgggtggcgcggaaaaactgcttggccgcggggacatgctgtttttgccggttggggcttccaaaccggtacgcgtccagggcgcttatctttccgatgaagaagttgaagaagtcgttgatttcgtcatttcccagcaaaaagcacagtaccaggaagagatgattccggaagagcctcaggaccaaccggatttcgacgatgaattatatgatgaagcggttctcttaatctcggaaatgcagaccgcttccgtctccatgttgcagcgccgtttccggattggctatacaagggcggcgcggctgattgatgcaatggaggcaagaggggttgtcgggccgtatgaaggcagcaagccgcgtgcggttttaatcccgaaaccttcagaagaacagagctcatagcacgccaaagaaaaaacctgcgcacaccttagcggccacaaaacgccgcggtgcgcgcaggttttactattttcgacaaaaatataaatttatgtttctttcgcaattaaaaaatgatatatttatgtcggtaagcaggataataggctgtttctaaagactgttatccaaaataactttcccggggggaacaaaagtgaaaaaacgtaaatttggtttggctcttgccgctgtcctggcagcagggacgcttctcggcgcatgcggcacaaagagcgacaattccgcaagcaaaggtaaggacaagttcaccgttgcactcgtaaccgatacgggcggaattgacgatcgttcttttaaccagtcggcatgggaaggcttacagcagttcgggaaggacaatcacttatcaaaaggtaaaggcggctttgactatttgcaatccaaatcggatgcagattacacaacaaatctgaacacggccgtccggaaccagtttgacctcgtttacggcgtcggctacaagctgaagccggccattgaaaaaattgcggatcagcgtaaaaataccaatttcgcaatcattgacgatgtcattaccggaaagaaaaatgtggcaagcattacgtttaaagaacaagaaggttccttccttgtcggggtcgtggcaggcctggcgacaaaaacaaataaaatcggatttatcggcgggacagacagcgatttgatcaacaaattcgcagccgggttccgtgcgggcgtcaaagctgccaatccgaaagcaaatgtgcaaattcaatatgtcggctcgtttgatgatgcaagcaaagggcagtcgatggcttcagcaatgtataaatctggcatcgacgtgatttatcatgcagccggtggcagcgggaaaggcgtctttacagaagcgaaaaatataaaacagaatgatccgaacaaaaacgtctgggtgatcggtgtggaccgcgaccaggcagatgaaggaaaggtaacggttaaaggaaaggaatacaatgtgacactgacttcaatggtcaaacgggttgataaggcagttatcgatttatcgaccagagcgaaggacggcaaatttccgggtgggaaaaatattgtttacggcttgaaagaagatgccatcgggattgcgccgacacaggacaatttaacgcctgaaatgaaatcggccgtgaaagactggaaacaaaagatcattaacgggaaagtgaacattccgtcaaaattgaagtaatcgatccatctcacgggactggtttttgccggtcccgtgttaaaaatgtttaaaaaatgaaacaatttcagccacaaaggcagggcggattccccgaagctgctgtctaaagacgccatgacgattgctttctttataccccaatgttaaggagtgataaagggtggattacgtaattgaaatgctccatattcgcaaagaatttccgggaattgttgcgaacgatgacatcaccctgcaggtaaaaaaaggagaaatccacgcgctgcttggagaaaacggcgccggaaagtcgacgttaatgaatgtgcttttcgggctgtatcagccggaaaagggagaaatccgtgtaaacggccagaaagtgaacattacagatccgaatgtcgcaaatgatctcggcatcggcatggttcatcagcattttatgctcattgataagtttacggtgactgaaaatattatcctcggcaaggaaccgaaaaaatcctttaccatcgatatcaaaaaagcggaacagcaagtccgggaaatttccgaccgttacgggctggatgtggatccgcaagcgaaaatttcagatatttccgtcggtatgcagcagcgggtggaaattttaaaaacgctgtaccggggcgcagaaatccttatttttgacgaaccaacggctgtgcttacgccacaggagatccatgaactgatcggcatcatgaagacgctgatccaggaaggaaaatccatcattttaattacccacaaattgaaagaaattatggaagtatgcgacagggttaccgtcatccgcaaagggaagggcatcgggacgctcaatgtccaagatacaaacccgcaggagctcgcccatttaatggtcgggcgggatgtccttttcaagacggaaaaaacggagggccgcccgggacaaaatgtgcttgaaatcgagcaattgcatgtgaaagattcacgcggggtggaagcggtcagagggctggatttaacggtcagggccggcgaaattgtcggtattgccggtgtggacggtaacgggcaatcagagctgattgaagcgattacagggctcagaaaagcagacagcggcacggtccgcctgaacggtaaaaacattacgaacttaaggccgcgcaaagtaacggaagcgggcgtctcccatattcccgaggacaggcataaatacgggcttgtactcgattatacgatcggggaaaacatggtgctgcaaacgtattacaaaaacccaatgtcccgtaacggtatcttaaattacaaagaaatttataaaaaggcaaaatcgattattgcagaattcgatgtccgtaccccaagcgaatttacaaaagcgcgggcgctctcagggggaaaccagcagaaagcgatcatcgggcgtgaagtggaccgcgatccggaccttttgattgcggcacagccgacccgcgggcttgatgtcggggcaattgagtttatccacaggcggctgattgaacagcgagaccacggaaaggctgtcctgcttgtatcgtttgaactggatgaaattatgaacttaagtgaccggattgccgtcatctacgaaggagccatcattgatattgtcgatccgaagcagacgacagaacaggagctcgggctcttgatggccggttccaaaaaagaaagggaaggtgaacaaaccaatgtctaaccgaacattgaaccttctgatccctgtcgtgtctgtcattctcggacttttggcaggcgcattgattatgcttgtcagcggctataacccggtggatggatatattgcactctggaacggcgctttcggccaggctttttacgtcggcgaaacgctgcggcttgcaacgccttatatttttgcggggcttgccattgcctttgcgttccggaccgggctgtttaatatcggggctgaaggccagctgatcgtcgggtggattgcggctgtctgggtcggcgttgcttttgatctgccaaaagtgatccacttgccgctcgcgatacttgccgcctgctgcgccggggcattttggggattcattcccggccttttgaaagcgcggctcagggtgcacgaagtgattgtgaccattatgatgaattatattgcgctgcacacatccaactatttaatccggaatgtgctttcaaaacagcaggatacgacaccgcatattcatcattcggcatcgctttcgtctccgttttttcagaagattactgacttttccactttgcacaatggcatttaccttgctttggttgctgttgtggtgatgtggtttatcattgaaaagaccacgctcggctttgaactgaaatcggtcgggtttaaccagagcgcatccgaatacgctggcatgagtgtgaatcgcagcattatcctttctatggtcatctccggcgcttttgccgggctcggcggcgcaatggaagggctcgggaattacggctttgcctttttgcaatctaacttctccggcatcgggtttgacggtattgcagtggcgctgctcggcgggaatacagcgcccggcgttttgatcgcagctgttttattcggcgctttaaaagtcggctcgctgaacatgccggtcgatgccaacgtgccaaatgagctggtcaacattgtcattgctttgattattctttttgtcgcatccggctatatcatcaaatggtccctggcccgtttgaaaagggaggcgaaataaaatgcattttatgaccgctttggaaatcattatttcggcgtctttactatctgcagcaccgcttatttttactgctttggggggcgttttctccgaacgttccggcgtggtgaacatcggccttgaagggttaatgatcatgggggcttttatatcgattgtctttaatttaacgttttctcatgccctgggcgcctggacgccgtggatcgcggtgctggtggcgatgcttgtcggcggattatttgccttgatccatgcggctgcatccatttctttccgcgccgaccagacagtcagcggcgttgcgattaacttccttgcgctcggcgtcgcgatgtttctcatcaaaaacatttacgggaaaggccagaccaatacgatcagcgaatatttccagcaggtggatgttcccggcctcagccatattcccgggatcggcaaactgtttttccaggggattacatacccttcttacattgccatcctgattgcgattctcgtctggtttatcctttacaaaacgccgttcggcctacgcctccgttcggtcggggaacatccgatggcggccgatacgatgggcatcaatgttgtaaaaatgcgctactttgccgtctttttatccggtgtattcggcggaatcggcggggccgtgtacgcacagtcgatcaccctgaatttcagttcttcgacgatttcagggcaagggtatatggcgctggctgcgatgattttcggcaaatggaatccgctcggcgcgatgggggccgctttatttttcggatttgcacagagcctcagcatcgttggcaacagcattccgtatttgaaagaaatcccgagcgtttatttgctcattgcgccgtatgtcctgaccattctggcactcgccggattcatcgggcgtgcggaagccccgaaagcagacggcgtcccttatatcaagggtgaacgctaggttattccatccggcatcaggctgctttcccgcctggtgccggtttctttatgtgccgtaaaacttgccgggacacctgtctcccttgtatagtaaaattaatgcatttacaggttaaacaaccccctagtcaggcatacttttactattggcacgaagctcgttgaaaaaggaggatccatatggccatttcaaaagagacggttcgcaaaatgaaagggtacacactacataccatcaaaacggacaaatacaaaacgaatacgcttgtatggaaaatgaaagcgccgcttgaaaaagacaccgttacgctgcgggccctgctcccgaatgtgcttcaaagcagcacaaagcgtttgaatacaaccgcaaaattaagggcgtatctcgatgatttgtacggcgctcatttttatgtcgatacggccaaaaaaggggaataccatattctaacctttacaattgaaattgcgaacgaaaagtttttgcaggatgcagaaccgctgctccaacggggggttgaatttttggcggaagttttgctgaacccgcatgcagacggcgggcagtttgacagccaaacggtggagaaggaaaaacgggtgctgaaacagcggatccagtctgtatacgatgataaaatgcggtatgcaagcatgcggctgattgaagaaatgtgcaaaggagagccgtacgcactgcaggcaaacggtgttcttgatgatgtggatgccatcacgcctgccgatctttatcaatattatcaaaaagccatccgggaagatgaactggacttatttgtgacgggcgatgtcgatgaagaccggcttgcggccatttgcgaatgcctgcgttttccggaccgcgagccgaaacgtgctgctgcaagaacgcttcaaaaggtctccagcgtcaaaaaaatcaaagaatcgcaggatatccgccagggcaagctgaatatcggctaccgcaccaatattacgttcggagacagcgattattttccgctccagatgtttaacggcattttcggcggtttttcccactccaagcttttcctgaatgtacgggagaaagaaagcctttgctattatgtcgcgagccagatcgagagccataaagggctcatgatggtgatgagcggcatcgaatccgcgaattttgacaaggccgtctccattattgaaaaacagctggaagcaatgaaaaacggcgatttcagtgagcaggaaatcgggcaaacgaaagccgttatccgcaaccagctgcttgagtcaacggatacatcccgcggcctcgttgaaattttgtaccataacgtcattgccggcaccaagaccggcgtggaagactggataagggaaatcaaggcagtcggaaaaggggagattgtgaaagtggcggcaaaaattgaacccgatacgatctacttcttgtccggaatggaggggaaataaatggaaacccaacaattcagccagcttggcgaaacgctttacggtgaaacacttgataacggattaaaagtctatgtgctcccgaagcgcgggtttaacaaaacatttgtcacgtttacgacaaaatacggttctgttgacaatacgtttgtcccgcttggaaaaagcgattttgtgcgggtcccggacggcattgcccattttctcgaacataaaatgtttgaaaaagaagacggggatgtgtttcagcaattcagccggcagggcgcatccgccaatgcttttacaagttttaaccggacggcctacctgttttcaagcaccgatcaggtgatgaaaaacctggaaacgctggtcgatatggtgcaaacgccgtattttaccgcacagacggttgaaaaagaaaagggaattatcggccaggaaatcatgatgtacaatgacaacccggactggcggctgtattacggcctgattgaaaatttatatgcaaaccacccggtaaaaattgacattgccggcacggttgactcgatcgcaaaaatcaccgcggagcaattgtacgagtgttaccatacattttatcatccgagcaatatgctgctgtttgccgtcggaaatgtatcgccggatgaggttctttcttttatgagagaaaaccaggcgaagaaaaagtacgaaaaagcaccggagattaaaaggcgttttccggaagaaccagcacaggcggccgaaaaagagcagaaattgcatatgaatgtgcagattccaaaatgccttgttggcgttaaggcgcttcatacgagccagcgcggcgctgaaatgcaaaagaacgaacttgtggtcaatcttctccttgacatgctgttcgggcgcagttcagatgcgtacaatgcgttgtacaatgacggcctgatcgacaccagtttttcttttgactattcccaggagcagggatttggatttgcgatggccggaggggatacgaaagatccggaccttttggcaaaacggctgaaagaggtgatgattgcggcaaaagaaggaaaaggtttggcggaagaagcgcttgaacggacgaaaaagaaaaaaattgggggattcctgcgccagctgaattcacctgaatttatcgccaaccagtttacaagatatgcgtttaatgatatgaatttatttgacgtcgtccctgcgcttgaacaaatccggttcagtgatgtgctggaaacggcggaagctttttttgaagaagaacggtttaccgtttgccaagttttaccgaaataacccgggactctcccgggtttttaagtgggggagaaaattgaaaaagtttgcgttgattacgggtgcgagtggcggcatcgggaaggcaacagctgaaatgctggcaaaagaaggatggaatttgtatttgcattaccatcaaaatgaagcggccatcaaagaactgctttccatttgccggcatttcggggcggaagcgatcccgatccgcgccgatcttgcaacggacggcaccgtaaaaacgattgcagaaaatgtttttcatctcgatgcgatcatccatgcggccggcatttcccattacgggctgctttcggatatcgatgaggcagccattgacaagctttaccggattcatgtgaaggcgccgcttctgatcatcaggcagctgttgcccaaattgcggcaaaatgcggtttcacacattgtgcttgtcagttcaatctggggacaggcaggcgcggcgtgcgaagccgtatattcggcgatgaaaggcgcacagatcgcatttgtaaaagcactcgccaaagaaacggcaagaagcggcgtacgcgtgaatgcggtcgcgcccggggcggttggcaccaatatgctttcaaggtttacgccggaagaaatggcagatctcgaagcggacatcccactcggccggcttgccaaaccggaagaaattgccggcacggtttctttcctgctctcggaaaaaagcaactacatcaccggtcagacgattggcgttaacgggggctggtatatgtagtcccgcctggaaaaagttgcaaaggaatccgccctgttttttcgcggattaaccaaaaaagggcaacagcacaccgttttgcccggccggtgctttgaaagaagcacgggttccattttccatgcatagccttccacaccgggtcacaaactaaggttgaacaacttgaaaggaggctgtgacatgaacgtattagaaaactgggaccaatggaaaaactttttgggggaccgtctcaaccaggcaaaacaacaggggatgccccagggaacgattaacaaacttgctgagcaagtcggtgattatttggccgcacaagtagatccgaaaaatgaacaggaacgcgttcttgctgacttatggtcagtggcatcgcaggaagaacagcaagccattgccaatgtaatggtaaaactcgttcaaaataacggtacccagtcataaagaaataccggcgcatcatgataacaattggctgcttttttacaagaaaagccggttgtttggctgatgccgccggttttttcatgtcacgacaaaattcacgatttttagagctttcgcttccttattgatgtaaaatcatatatcatataacctagatatgttcgtttggatccggatttcgggaggggttttgagtggatgacaggaaagagtggtacttggaatatgaaatcacgatcaaccggccggggcttttgggtgatatttcctctctcttgggcatgttagcgatcaatattagaagcattaacggcgttgaccataaaaaacgaggcttgctgctgtttgtcaaaaatgaagaacagatcggccggctcgaatcgatattgcgaacagtggaaacgataaaagtaacgaaaatcagggaatccaagctcagggacaggcttgcagtccggcacggaaggtatatccagcgcgatcatgacgaccggaaaacattccgctttgtgcgcgatgatctcgggattctggtcgattttatggccgagcattttaaacaggaaggccataagctgattggcattcgcgggatgccgcgcgtcggaaaaacagaatcgattgtggctgcaagcgtgtgcgccaataaaaagtggatttttctctcctccacgatgatcaaacagacggtgagaagtagtctgattgaggatgaatacaatgcaaacaatatttttatcctggatggcgtcgtatccgctgagaggggaaacgaacggcactggcagctgatccgtgaaatcatgcggcttccggctgttaaagtggtggaacacccggatattttcgtgcagcgttcggaatacacgcttgatgattttgattacattattgagttgagagaagacccgtcacaggaaattacatatgacttactccagcaaaaccggatgtttcaaggcgaatttggaggatttgattactagattggcaggtgttaccatgacggaattagggaatcgtttaaaagaagcaaggaaagaaaagggcatcagcctggatgatttgcaggagatgaccaagatccaaaaaagatatttgaaaaacattgaagaaggaaattatgattcaatgcctggaaaattttacgtccgggcatttattaagcagtatgccgaggcagtcgggcttgatccggaaactttatttgaagagtaccagagcgacatcccccgtacggaacaggaagaatttcccgagcaactttcgcgggtgcagacgtcctccaaaagggccgcaccggataccgtcaagatgatgaacgtgttgccaaggatccttgtggtcgccgccatcatcgcgattttatttttgctttggtttgttgtatataagtttgccggtcacaacacaaaggaaaaattaaacagcggggcttccggcaatgtgagcgtacaaaaagaaaacgtcaaatcggctgaaaaggtgtcatccggcaaaaacaccggcagctcttccgaaaaaaaggcggcgaaaacgtcaaaaaaaccggcctcgaaaacgaagaaaacagcccaaaaactggaaaccgtatcttcaagcgggtacacgaccacctataaactggccggcaccaaccagttcaaacttgaactgaaagcaaacggcggacggtcatgggtacaggtgaaaaacagcgacggttcaacgaactttcaacaattgctgaatgacggggacagccggacagcggatctgtcaaaacaaaaacaagtcacgatcacggtcggaaacaccgtcaatacggaagtgtatatcaatggcaaaaaactaaaatacaatattccggcatccaaagaagtacgccaggatatgatcgtccagtttaacgggtcacaaacgaaataagccttgttttaaggctttttctttggaaaatatatagacagttggaggaaaagccagtgaatttgccgaataaaattactgtatcacgtgtatgtttaatccctgtttttttactcatcatggcggtgccgttcgattggggcacctttgattggctgggagccaaaattccggtcacccattttgtcggtgcggtgatttttgccattgcctctatgacagactggatcgacggccactatgcccgcaaatacaatctcgttaccaacttcgggaaatttctcgatccgcttgcggacaaactgcttgtttcaacggcgtttattttgctcgttgggctcaagctggcgccggcatggattgttgtcgtaatcattgcccgcgagtttgccgtgacaggcttgcgactgattttagcagagggcggggaagtagcagcagccaatatgcttgggaaaatcaaaacatggacgcaaatcattgccatccttttattgctgttgcataactttccgttttcggcgctctcttttcgcttggatctgatcgctttgtgggtagcgctcatctttaccatctggtcaggcgctgattatttctatttaaaccggggcgtatttgcccgctcgaaataaccatgcagtgaaaggcagcctttcactgcttttttgcccgccagtggcttgtgctaatccggcacgggagaaaaaggcagccattgcttcgggtggattggcggcctggattgcgccgtcatgtgttcgtttttttgctttaaaagaaagggaggaatggaaagtgaatgccgaaattattgcagtcggttcggaacttttgcttggccagatcaccaatacaaatgccacatttattgccgcacaattggcggagatcggcgtggatgtgtactaccagaccgttgtcggcgataacgcagagcggctcgaagcggcaatccggacagcggagggccgcgccgatctattgatttttactggtgggctcggtccgacaaaggatgatttaacaaaagaaacgattgcatcgcacatcgaaaaaaaactggtgacaaacgaagatgccatgcgctccatcgaacagttttttatccgtacaaaacgaaaaatgacggaaaacaacaaaaagcaggcactggtcatcgaaggttcaaaagtgtttccgaatgaccacggtatggcgccgggcatgctggccaaaagcggaaaccattattatatgctgctgcccggcccgccgcatgaactggaaccgatgtttatccattacgccagccccgcaatccaggaagaactggaaacgatcgaaaaaatcgaatcgcgcgttctccgcttcttcgggatcggcgaatcccagctggaaacagaaatccgccatatattggatagccaaaccaatccgactgtcgctccgcttgcgaaagaaggggaagtgacacttaggattacggcgaaacaccagtcggcggaaacggcgaacgaaatgatcgatcaagtggaaaaagagattatgcaaattgccggatcgtatttttacggttataatgatatgacattaatggaggccctgctcgaaaagctttcgaaaaaacagctgacgcttgcctgcgcggaaagtctgactgccggcaaatttgcagcggaaatggcgtccatccagggtgtcagcacaatgttgaaaggcggcgttgtcgtctattcaaacgaagcgaagatgaagcttgccaaagtgaaaaaagaaacgcttgacaagtacggcgccgtcagcagccagtgtgcaaaagaactggcggaaaatatccgcagcattatggatgccgacattggcatcagttttacaggcgtggctggcccggactcccttgaaggccatccgccgggaaccgtgtggatcggcattgcgataaaagggaaagaaactgccacttatctgttggaacttcccggatcccgcaacaacatccgcacgcgatcggtgaaatacggctgctggcatttgctgaaactgctttaggtcgaaagccgcttctgctcatggcaagtgacggaagcggcctttttataaaaaaatttgtttgccaaaaattcaattttcggctctttttgccgggggaattttcatttttacagggggaaaaccccatttttttgccggatttttgcaaaaaagagacgaatgagcgttcgagattttgcttggcaaacagagaaaaaacgggtatagtatagatatagattcattgctttcgagagtttggaatgaataaaaggaggaaattttgtgaatgatcgtcaagaagccttagacaaggctctgaaacaaatagaaaagcaatttggtaagggttccattatgcggttgggcgagcagaccgaccgggttgtctccacgatcccgaccggttcgcttgcgcttgatattgcccttggtgtcggtggttacccgcgcggccgcgtcattgaaatatacggccctgaaagttctggtaaaacaacggttgccctgcatgcgattgcggaagtccaggcacagggtggacaagcggcgtttattgatgcggaacatgcacttgacccggtttatgcccaaaagctcggtgtcaatattgatgagctgctcctgtcccagccggatacgggcgaacaggcgctggaaattgcggaagcgctcgtccgcagcggcgcagtggatattgtggtcgttgactccgttgctgcgcttgtgccgagagcggaaattgaaggggaaatgggcgattcccacgtcggcctccaggcacggctgatgtcccaggcgctgcggaaattatcgggtgcaatcaacaaatcgaacacgattgcgattttcattaaccaaatccgggaaaaagtcggcgtaatgttcggtaatcctgaagtcacaccgggcggccgtgcgctcaaattctactcatccgtgcgccttgaagtgcgccgtgccgaacagatcaaacaagggagcgacattgtcggcaacaaaacgaaaatcaaggttgtcaaaaacaaagtagcgcctccgtttaaaacggcagaagtggatattatgtacggcgaggggatctcaaaagaaggcgagatcgtcgatatgggaagcgaccttgacatcatccaaaaaagcggggcctggtatgcttataacggcgagcggctcggccaggggcgtgaaaatgcgaagcaatttttaaaggaaaatgcggatctgaaaaacgagattgccgcaaaaatccgggaacattacgacctgacagaagatgccggttcccatgaaaccgagaaagctatagatgaacaagaagctgtggaaggacaggaagaattaaatttggagtaaccggtgtataagcgcctgaaatgctgaccgcatccaggcgctttttgccgtccatttaccgcacttttttgcgccacaaaatctgcatggcggagaggaatcaacacaaatttacaatggcaatctttccgcttcacttgacaataaaaattcccacctttaaaattaatatgtatattttatttttctaaaaatgactttctcctgtacggaaagcaaatcctcccggaagtttccggaaggggggccggttttttcatccggcggcttttccgcatgcggctgatggaaccatccttgtcttcagccggaccgggacgaaacgcatgattgggttttcatgcatatacaccggaggggcttgccccgggatcaacgttttactttttaagccaggcgctgtatactgtaaacctaaggattaatgtaacagccgacatttttaacgtagaagaagttcatagcaagaggaggtgagattgatggagtctctcatatggatcatctcccttttgcttgtccttatcgtcggtgtagttgttggctatttcatccggagatcaatttatgaagcgaaaattgcaggggcgaaaaatgcggcagatcagatcgttgatgaagcaaaacgcgaagctgatcgcctgaaaaaagaagccctgcttgaagcgaaggatgaaaatcataaacttcgtacggatatggaacgggaattgcgtgaacgaagaaatgaattgcaaagacaggaaaaccgcttattgcaaaaggaagagaacctcgatcgcaaagatgaatcgctcgataagcgtgaatcgatgcttgaaaagaaagaggattctttaaacctgagacaacaacatattgaagagatggaaagcaaattggaggagatggttaacgagcaggagtctgagctggaaagaatctcgggcctcaatcgcgaacaggcgaaagccatcattattgaaaaactggaaaacgagctttcccatgacattgccgttaaggtaaaggaagcggaaacaagggcaaaagaagaagccgataaaaaggcgaaaagcattctttcgctggccattcagcggtgtgcagccgagcatgttgctgaaacaacggtatcggttgtcaacctgccgaatgatgaaatgaaaggccgcatcatcggaagggaaggccgcaatatccggacacttgaaacgctgaccgggattgacctgatcatcgatgatacgccggaagcggtgattctttcgggattcgatccagtgcgccgggaaacggcacgcattgcactggaaaaactggttcaagacggccgcatccatccggcccgcattgaagaaatggttgaaaaagcaaggcgggaagtggatgaacatatacgcgaagtgggggaacaaaccacttttgaagttggtgtccatggcctccatccggacttaatcaaaattcttggccggttaaaattccgcacgagctacgggcaaaatgtcctcaagcactcgatagaagtcgcattcctttccggattgctggctgccgaactcggggaagatgaaatccttgcccgccgtgccggtctgcttcatgatatcggaaaagcggtagaccatgaagtagaaggaagccatgtgcaaattggcgtcgaactcgcaaccaaatacaaagaacatccggtggtcattaacagtattgcttctcaccatggcgatacggaaccgacctctgttatcgcggtgcttgtcgctgccgctgatgctttatccgctgcacggcctggggcgcgcagcgaaacgcttgagcattacatcagacggcttgaaaagctggaggaaatcgccgaatcgtatgacggtgttgaaaaatcgttcgcgatccaggcggggagagaagtacgcattatggtgaaaccggaacagatcgacgacctggaagctcatcgcctggcacgtgatatccgcaaaaaaattgaaaatgagctggattatccgggccatattaaagtaacggttattcgggaaacgcgggctgttgaatatgcaaaataagcggtgacgtgttcaccgcttattttctttaacgttttgaaaagaaaataaagattgttttacaaagcatagaaaggatttattgcatgaagattttatttataggggatgttgtagggtcattagggcgtgagatggtgaatgaatatttgccgaagttaaaggcgaaatacaggccgcatttgaccatcgtaaacggggaaaatgcagccggcgggcgtgggattaccaaaaatatttaccgcggcctgctggatgcaggtgcggatatcatcacgctcggaaaccatgcatgggacaacaaagagattttcgactttattgaggatgcaaaatggatggtgcgcccggccaattttccggacgggaccccgggaaaagggatggcgttgatcaaagcggaaggaacggagtttgcagtcatcaacctgcagggcagaacgtttatgaacgcgctcgatgacccgttccggaaagcagaagagatggtggcactggcaagaaaaagaactcattttatctttgttgattttcatgccgaaacgacaagcgaaaagcaggcgatgggctggtttctcgacggcaaagtgtctgccgtgatcgggacgcatacgcatgtgcaaaccgcggatgcaagaattttgccaaacggtacagcctatctgaccgatgccggcatgaccgggccgtacgatgccattctcggcatggacaaagaagcggtaatgaaaaaattcctgacttcgcttcctgtccgttttgaagtgccgaaatcgggaaggaaaatattaagcggatgcatcatcagccttgataaaaaaacaggcaaagccgcaacgatccagaacattttaattaatgaagaccacccgtttatctctgaataaacgggttttttctttttccggatgggtgccgggcaggacagcgcctctttttatgtaccggtgcttatgaaggatggcataactcgcagaacaaaggaatatagtagcagtgaaatgatttttcccgctgtgcggggggcagctccccggagtttttttgagcaagagacgttcacgaaagcccgcacgacaagcaggaaaatcagtagcctatatgcggggcggctgccggattgtttcggacagccgccccgtttccagcgaagccgggaaaaggccgggctggaaacgggcaagagatacttcacgttcgaacatgaatcgtcactctgaacggacattcggttaacggaaggagacaaggaggagaaggaatggaaatattaaaagtttcagcaaaatctaatcctaattctgtagctggtgcacttgccggtgttcttcgtgaaagagggggggcggaaatccaggcgatcggggcgggcgccattaatcaggctgtaaaagccgttgccatcgcaagagggtttgtggccccgagcggtgtggatttaatttgcatcccggctttcacggatattcagattgaaggagaagaaagaaccgctattaaactcatcattgaaccccgctgatatagattgaaaagaaacgctgtttgcagaagcagacagcttttttttgtatggaaaaaaggtttgcggaaactgtcatactttatcagcaaaaagaacccgtccacgtgataaagtaaaatcgtggcgcgctttatctttgcgccttttttactgcagcctgaaaagtggctgaaggaggggtggaagttgatccatatcattgctactgctgaatcgtccgggcaggctgaagcgctgattgcggccggagtggataccctctatatcggggggaaccgtttcggcttgcgcatgcccggccatatcacgcttgaagacataggcgacattacaaagtttgcacaccggcagaatagaaaagtgtatacagccgttaacggattgatgcataacggccatatagaggcgcttccggaatatttgttatcacttgaaaaagcgggagtggatgcgattactgccggggatccgggcgtgatacagctcttaaaagaaatgaaactgaatctgccttatatttacgatgcacagacgcttgtcacatcggcaaaccagataaagttctggctcaaacgcggggcaataggggccgtggcggcgcgcgaatgtacttttattgaattaaaagagatacaggcgcaaatcaagcaacccgtcgaggtacaagtatacggcccgacatgcatccaccactcgaagcgccgcttgctttcgaattacacccaatttgcgcatcttaatgccggcacaactgtccgtgacaggctcagcatcagcgagaaaaaagacagggaaaatcagtatccgctttttgaggatgaaaatggcacccatattttttccgcagaagacattgcgctcattcggtatttgccggatctgcacagggcggggctggatacgtggaaactcgacggcattttggccgaaggggaaacctttacggatattgccgccctttatgtccgggcaaaagaagcggtgctgtccggcacttttgatgcggcgcgtttttcagctgagcttttgcaattgcagccggaaacgcggaagcttggcacggggtttttcctgcggcagccggatgaagtacagtaggagggagaatatgcgaaacatcatcaaaaaaccggaagtgcttgcgccggccggaaatcttgaaaaactggaaatcgccgtccgctatggcgcggatgccgtatatattggcggacaggcttacggcttgcgttcaagagccggcaattttacgtatgacgaaatgaaggaaggggtccgctttgcgcatgcccgcggcgcaaaagtgtatgtagctgcaaatatggtcggccatgaaggcgatgatgaaggggcaggggattttttccgcacattaaaggagatcgggattgacgctgtcatcatctccgacccgggttttatcaccatttgtatggaagaggcgcccggccttgccgtccatttgtcgacccaggcttctgcaacaaattacaaagcgcttcagttctgggagcaggaaggggtcgaaagggtggtcctggcccgcgaagtcagccttgaagaaatccgcgaaatccggaaaaataccggtatggaaatagaggcgtttgtacagggggcgatgtgcatttcgtattccgggcgttgcgtactgtccaatcatatggcgaaccgcgatgcaaaccgcggcggatgcgcccagtcatgccgttggaaatatgacttgtttgaaaatgaaggagccgacatcttaacagctggcggcgagccgttttccatgagtgcggtggaccttacgatgatccatcacgtgccggaattgattgaagcgggtgtgggaagttttaaaattgaaggcagaatgaagtcgatccactatgtttcgactgtggcgaatgtgtaccgggcgattgtcgatgcctattgtgaagatccggaccattttgtttttgacccggcgtgggaggaagaaatttggaaagtggcacaacgggaactggccaccggtttttactttggggaaccggatgcccaccagcaactgttcgggcgcccccgcaaaattccgaaatatactttcgctgcccgtgttttggattacgatccggctacaaaaatcgccacgcttgaacagcgcaaccattttacgacaggggaagaagtggagttttacgggccgggatttgcccgtttcacccaaaccatccgcaagctttgggatgaagacggcaagtgcattgaacgtgccccgaatgcgatgatgaccgtgaaaacaatcgtcgaccatcctgtaaaaccttatgatttgatgcggatacgcaaaatgccggtgagtacggcacgcttttcaaactttcctggacaggctccaagtgaatgaaaatttacctcaaaacggcgggatacaaaaatacgttcccgccgtttttgcatccccggctttcgtcaatttgccttccaatggtatgcaaaacaggtgaaactatgcaatattgcataagaaactttccgtttttccccctacccctccgaactcccgcgactgcttttcctgaattctgagtttttcaaatcctcctcttgtttttctaataattggtatgaaaattgcaaagatgtagaataataggccttcgcatggatggaagcggagcagccttattagcgtaccaaaaagcaaacatctttgattcgtggaagagagagggaggatgataaaattggagaatgcgacattaaagcgttcactcggtttatgggccatcgtcggacttggattagggtatatgacgcctaccattgtgtttgatacttttggcatcgtatcaaaggaaaccaacggggtggtgccgcttgcctatatcactgcgttgattgtcatgctgtttaccgccatcagttacgggaagatggtaaaagttttcccgaacgccggatctgcctacacgtatacaagggaaacgatgaacccccatctcggtttccttgtcgggtgggcggcgttgctcgactatttgctgttgcccatggtgaatgctttaattatccggatttatatggtatccgtctttccaaacgtgcccgcctggatctgggtggtgacgtatgtagccgccgtgacgggcatcaatgtatggagcatggggaaaacgtccaatatgaacaccattcttgtcgtttttgaactcgtgctaatcggtgcttttcttgtgctggccgttgtacaattttcgcacggaatgggaaaaggtacggttttcactttcgatccgctttaccactccaatgtccgtttgagcgcggtcctgaccggagcgacagtcgtatgcttctcgtttatcggctttgatgcggtaacgatgtatgcggaggaagcgaaagatcccaaaatcatgccgagagcgatcatgctaacggtttttatcggcggtgcggtcttctttatcgccagttatttcgcgcaagccttgtttccggacgtttcccattttaaaaacacggatgacacattgcccgaaatcggattgtatgtgggcggaacgctgtttaaattattgtttatttccggtgcatttgccgccacggttgcgtccggccttgcttcccatgccagtgtttcgcggctgttatatgtgatggggagaaacggcgtcctgccgaagcgatggttcgggtacgtgcatccgaaattccggacccccgcatggaatgtaatccttgtcggcctggtgtcgctgcttgcgatcacgcccagcctggaactcatttcctcgtttatcaactttggcgccctgattgcttttacattcgtcaatttatctgttattgccttctttgtcttccggaaaaagcgctataaaacggcaaaagatgtgttttcctacctggtgatgcctttagccggggcagggctgacgggcgttttatggtccaacttgcaaaaagacgccctcattttcggcattatctggtcaggcatcggatttatttatatggcgatccaaacgaaatttttccgcaagcaggtcatcgattttcaattggatgaagcagaaaaaacttctattctttaagataaaaagcaatggttacatggcagaagatgtgcaggcatcttctttttttgtgccggactatttccaatattaaaatatagtgatactatatttttagaaggtgcaaggaggaatcgcaatgccggcaattgcaaaagaaaaaataaagccgatcatccccttttcggttgacggtgaagaagatttaaggctggcgttacaaaagcataaagggccttttctgtttttaaagaaggacggagaattatttgcctatgccttgctgaatcatcaactgctggaaaagcttaaaaaaggcaacttttcaaaagaaaccctgcttcgccacgcaaaaccgcttgacgggatcagccgtctcgatgaccatatttccattacgagcttgttccaaatcattggtgaaccatttgcgcttgtgagaagcgaagatggccgcccgtccggctacatccaaagagaggacatgctggcggagctctttaaacaggaaaacgaaagcgcccactttctgaaaatcttgctcgcatcgatcccaatgggcatttttgtgctcaacagggaaaaacggatcatccattgtaacgaagcaggtttacgaatgattaaattgccgcacgaagcggtgctgaatgcccctggtaaaagtattttcagccatgaccatatcgcaaaagcgtttgaaaccgggaaaacgtatctgaaccatcttgaattcgcaaacggggtcggggttttggccgactacagcccgattcaaaatttcgccggtgaagttgaaggcctgatcattgtcgttcaggatttgccgatggtagaagaaatggcacttgaaatcgaatatataaaagacttaaataaagacttgaatgcgattctgtcgacgatttatgacgaaattcttgtcgtcaatgcaaagggcgaactgcttcgctacggggagaacatcattgaagatttctggcaggtggacgtaaaaacgctgatcgggaaaaatatcctcgattttgaagaccagggcttattcaccccgtcggttataaggctcgtgatggaaaaacggaaaaaagtatccgttgtgcaggaaacgcggacgggaagaaaaattctggccgtcgggaacccggtttttaatgaaaaaggcgcgcttgaccggatcattattgcatcgcgggacataaccgagacgacccggttaaaaaccgaactgaaagagatgaaagaaatttcagcccggtacaaaaaagagctcgaccagttcaaaaacaaagaccggtttttgaaaaaaatgatttactgcagcccgaaaatggaaaaaatcatgcaccaggtaaagaaaatcgccgaattttcgtccactgttttactgtccggcgaatcgggcgtcggaaaagaagtcattgcccaggcgatccaccaattcgggaaaaggtcggaaaaaccgtttttaaaactgaactgcggtgcgattccggaaactttgctggaaagcgaattgttcggatatgtcaaaggcgcctttacaggtgcggaaaaaaacggaaaagaaggatactttaagcaggcggacggcggcattttgttccttgatgaaatcggcgaattgccggtgcacctgcaggtcaaattgctgcgggtgctgcaggaacaggaagtgatcccgatcggcagcacaacccccattaaaatcgatgtccagatcattgcggcgacaaatcaaaacctggcaaaaatggtggaagagggccggttccgggaagatttatattaccgattgaacgtcattccgatccggatcccgccgctccgggaacggccggaagatatatcgctgcttgccttccactttttgcagcaattaaacgaaaaatacggccggaagttttatttaacgcctgatgcgatcaatgtgctggaatgttacccgtggccgggaaatgtaagggaactgcaaaatattattgaaaggctggtcgtcactgcggaccatgctgccatcgatggcgggtttgtcagccagtttttaacattcggctctgaaaggaaaaaaatgaagccggtcgtcacaagaatcatgccgttgcaggaggcgatggagtccgtcgaggagcagctcattttgctggccatgaaccagtacaaaacgacaacaaaagcggcgaaagcactgggcatcagccagtcttccgtcagccgcaaataccaaaaaatattaaacaagaaaaacaggaaaacagaggatgccgttttcaagtaaagcttcttctaaaaacccctgctgccgcaaacaaagcctaaaaaacggcgggacgctaccattcacagtgtcccgccgtttttttgcagcctgcaacttgtttcagtgcctcccggtgtaaacgcgccggttttcttttttactttccccgctccgtttccatgcagaaaaaaatagcattatgcaaaactgcataatgctgtgcgtgcgaaaccgcataaatcaggctgaaaattaattggcacccttcttgcaagattattcgtcgaagagaataaaggaggatgaaaaatggtcggggtacaacaatccgtcatcaacctgaaaatgtatattaacggcgaatggatcgatgcagataaccgggaaacgcgtgccataaaaaatcctgcgaacggtgaaaccatcgccattgccccggaaggcaccacccgtgatgcccatgaagcagtggatgcagctcgaaaagcttttgaatcggggatatggtccggcattcctgcacaggaaagggcagcgtatttatttcaagttgccgataaaatcgacgaaaacgcgaaggctttaaccaggcttgaaacgttggacaacgggaaaccgttaagagaagcaagctatgatattgccgatgcggctgcctgtttccgttactacgccggcttaattacgaagcctgacgggtttacctaccatgtcgcagatccgatgcaggcaatggttgtccgggaacccgtcggggtatgcggccttatcgtgccatggaattatccgcttttaatgagcgtctggaaaatcgcgccggcactggcagccggaaatacgatcgtttttaaaccgtccgaggtgacgccggtgacagccatgaagctctttgaaatctttgaagaaatcggcttgccgaaaggtgtcgccaatatggtcatgggcgcggggccggtagtaggcgaggagatcgtcacccatccggaagtggatatgatttcctttaccggcggcacgaaaaccgggaaacatctgatgcggcaggcggccgatacgttgaaaaaagtttcccttgaactcggcgggaaatctccgaatattatttttgccgatgcagattttgaaacggccgttgattacgccttgtacggcattttcagcggggccggccaggtatgttccgccggctcgagaatccttgttgaagaaagcttgtacgaaagatttgtctcccattttgtggaaagagccgccaaaattaaagtcgggccgggggatgatccggatacggaaatgggcccgcttgtcagcgaagaacatatgaaaaaagtgctttcttatattgaaatcggcaagcaggaaggcgccaccttagcgcttggcggcaaccgcctattggaaaacgggctggataaagggtattttgtcgggccggccgtgtttgtggatgttaaacaaaacatgcggattgtccaggaggaaattttcggccctgtcgttgttattcaaaaattcaaggatgaggcggaagctgtaaaattggccaatgacacggtatacgggctggccggtgcggttttctccaatgacggggccaaggcgttaagggtcattaaaaagatccggtccggcattacgtggatcaattcctatcatcctacttataacgaagcgccgtggggcggctataagcaaagcggaatcgggcgcagcctcggcacattcgggctcgaagaatttcaggaaatcaaacaaatcaacatcaatttacaagtggaaccaaccggctggttttcacatgaaaaataaggagagatcataaatggggatagatatcaaacaagagaagaaaaacagcgaagaacaagcggtactcggttatattcataaagtgctgaatttaattgaaaaacaggaagtcacgcaggaagaagcggaatggattacgaaggaaacggtggacggattccgcgaatatgtgaatccgggctttctggaataccggaaaaccgtgacggaaggcggccagtttgcggcagtcgaatggtccgacagcggcgcctgttttaaagatgtaaacggcaaagaatatatcgactgtctgggcggtttcggaatctacaatgtcgggcaccgtaatccgaaagtcgtaaaagctgtgaccgaccagctgaaacgccaggcgctccacagccaggatttgcttgacccgcttcgggccatgcttgcaaaaatattggcggatatcacgcccggcgatttaaaatatgcgtttttcacaaacagcggaacggaaagcgtggaagcggcattgaaactcgcaaaaatgtacagcgaccggacaaccatcatttcgactacccgtgcttttcatgggaaaagcctcggttcattgtccgggacggcgaaaggcatgttccgcaaaccattccttccgcttgttccgggcttccgccatatcccgtacggcgacattgacatgatgcgaaaaacgtttgaaacatgcgcccttgtcggagaagatgttgcagccgtcatgctggagccgatccaaggggaaggcggcattattctcccgccggagggctacttgcaacaagtccgtgaactttgcgatgcgtttggcgcgctgctcatttttgatgaagtgcagaccggcatgggccgtaccggaaaaatgttcgcggcggaactttacggcgtcgtcccggatattctctgtctcgcgaaagcttttggcggcggtgtgatgcctgccggcgcggtggtcgcgaaagaagaagtgttcaaaagctggttcccgaatccgttcatgcatactaccactttcggcggaaatccgcttgcctgtgctgcggcaattgcaacgatcggtgtcctcatcgaggaaaagctgccggaacgcgcagctgttgccggggattatttcctgaacggcttaaaagaggcggcaaaaggccacgaagacattgtccaggaagtccgcgggaaagggttaatgatcgggatagaattccattcggatgaactcggttatgaagtggcaaaaggcatgtttgacgggggcgtgcttgtcgcaggcacattgattaattcgaaaactttgcgctttgaaccggcacttacaatcagctatgaagaaatcgaccaggttatccgtacgttcaaacacgttttatcgcaagtgaaggcataaaatgtaaaacggaagagaaacgcaaaaagcctctgcctgaaacaggaaggggctttttgcgccgggcacgaaggtaacggcttcttttttcccggtaaagcgcacagcccggtgttttgccaatgtgacaccggcacaaaccgcgaatgaatccgcgttaaatggttaaacaaacggcttttgaagtccggatgttccgggaatcgtgaaaaacttgacacataccgggaacgggggtttgttgtaataggagaaaaaaccatttatactggttatacgcatgatttttatatggttgccgcaaattgagcgcggcatggtgcaaacagaaaggggattgccatgaacgagaaacaacgtttggaacagcagcaagtgaaccctgtagagcctgcggacaaaaaatccgaaaaggactacagcaaatatttccaatcggtttatattccgccgaatttaaaagaagcaagaaaacggagccggaaaccagtccagtattttaaagacttcgaaatcgatgaagacttaaaaggcatgggcgacggattgaaattttacatccggacttacggctgccaaatgaacgaacatgacacggaagtgatggccggcatttttatgcagcttggttacacaccgaccgaaacggtggaagatgcggatgtggttctgctaaatacatgcgccatccgtgaaaatgccgaaaataaagtgtttggcgaaatcggccacctgaaaccgttgaaaacggaaaaaccggacatgctgatcggggtttgcggctgtatgtcgcaggaagaatccgtcgtcaataaaattttgcaaaaacacccgcatgtcgatatggttttcggcacccacaacattcaccgcctgccgcatattttaaaagaagcgtatatgtccaaggcaatggttgtggaagtatggtccaaagaaggcgacgtgatcgaaagcctgccgaaagtgcgcaaaggcaacatcaaggcatgggtaaacatcatgtacggatgcgataagttctgcacgtattgtatcgtgccgtatacgcgcggaaaagagcggtcaaggcgtccggaagacatcatccaggaagtgcgtgaactggcagccaaaggctacaaggaaatcacgctgctcggccagaacgtcaatgcctacggaaaagattttgatgaccttgaatacggacttggcgatttgatggatgatctgcgcaaaatcaacatcccgcgcatccgctttaccacgagccatccgcgcgatttcgacgaccgtctgatcgaagtgctggcgaaaaaaggaaaccttgtcgagcatatccatcttcctgtccagtctggttcaagcgaaattttaaaaattatgggccgcaaatatacgcgggaacaatatttggaactcgtcagaaaaatcaaagccgcgattccggatgtagcgctgtccaccgatattattgtcggtttcccgaacgaaaccgaagagcagtttgaagaaaccttgtccctgtataaagaagtcgggttcgaaacggcctatacgtttatttattctccgcgcgaaggcacgccggcagccagaatgaaagataatatcccgatggaagtgaaaaaggaaaggctgcagcgcctgaatgaactcgtcaatgcctattcaaaagcggccatggaaaaatacgaaggccaggttgtggaagtgcttgtagaaggcgaaagcaaaaacaatccggaaattttagccggttacacacgcaaaaacaaactcgtcaactttaaggggccgaaatcagcaattggaaaacttgtgcaggtaaaaattacgaaggcgaaaacatggtcactggacggggaaatggtggccgtgcctgatccggccggggtggaagcgtgatgcagaagtttacaaaagatgatatcgtcgcaaaagctgccgaacttgcgaaaatgattgcggaaacggaagaggtcgatttttttaagcgggcggaagcgcaaatcaatgaaaatgagagagtccgcaatttaattgccaatattaaagctttgcaaaagcaggctgtcaacttgcagcattatggaaaaaaagaagcattaaaacaagtagaagccaaaatagataaactggaggaagaactggacggcatcccggtcgttcaggaattcaagcagtcacaggtggacgtaaacgacctgctccagattgtcacaaataccatttccaatacggtcacggatgaaatcatcaaatcgaccggcggcgatcttttaaaaggccaaaccggatcccaggtgaaatattcttccggcaccctccactgaaaaaaacggtgtgcatctgtgcacaccgtttttttggtgcgcagcacaaggcaaatccattgtacgggcaccctcctattgtcgcggcatatgttaggattacccggaggtggcgagaaaaagaattggcacaccggcctgggtaaaagcataggatgaattgaaaatagatgaggagggttcgctcgaatggcagaatatagagaaatcattacaaaagcagtcgttgcgaaagggcgcaaatttacgcagtccaatcatacgatttgcccgccgcagcatccttcgagcattttaggctgctggattatcaaccataagtacgaagccaggaaaatagataaagaagttaaaatccgcggctcttatgatgtgaacatctggtattcccataatgacaatacgaagacatcggtcatgacggaaaaagtcgagtataccgataccgttaaattgcattacagggatccggattgcctggacgacaaagaagtcatcgcaagcgtcctgcagcagccgaattgcattgaagcggtcatttcgccaaacggcaataaaatcattgtcagtgttgaaagagagtttctcgtggaagtcatcggagaaacaaaggtttgtgttgccatctcgcctgaaggatgcagcgatgacgatgaatgggaagaagaaagcagcgacgagtttgaagaattaaaccctgactttttagtgggaagtgaagaagaatagaagccacaaactaggagacatgcactcctagtttttttctgggcatccggcggtaaaagcgcggccatttgccccaccaaaacgcatgcttagaatgcacgcgaaatcctgtaatgggttttgacacaggcagaaaaaacctggcatccctggaggagacattgaaaatcaacagacaaggcccggctttgtaaaatgatccgtatttcaatttatgaaggccttcatgcaaatatgttataataaacaggattgaagaatgattgaaaagcaggaaaggaatttggtaagaatggctgcgtataccccaatgatccagcaatatttgcaagtgaaggcggaatatcaggatgcctttttatttttccgtctcggcgatttttatgaaatgttcttcgaagatgccattaaagcgtcccaggaactggaaattacattaacgagcagggacggcggcggcgacgagaaaatcccgatgtgcggggtaccgtaccattccgccagcacttatattgaacagctgattgataaaggctataaagtggcgatatgtgaacagatggaagacccgaaactggcaaagggtgttgtcaagcgggaagtcatccagctgattacccctggcaccttgatggagggcaaatcgctcgcggaaaaagaaaaccactatattgcgtctgttgcatccccggcggacgggaatttcgcgattgcctatatagatttgtcaacaggggagggcagggcttgtcttttggaaggcccgtttgaagaagtactgaacgaactggcgtcgatcggcgcaaaagaagctgtggtagatccggaatttccggatgaatacgcgcggctaatgaaaaatacaggaaatatcaccatttcgtttgaaacggatacggctgtaaaggaaggctttgaaaggcttctgccccagttggaaccggagcttttgcggctggctgcagcaagactgttaaactatttattccgcacgcagaaaaggagcctcgatcatctgcagccggttgaaatgtatgaagtccgccggtttttaaatattgattattactccaagcgtaatctcgaactgactgagacgatccgcgggcaaggcaaaaaaggatcgcttttatggctgctcgatgaaacgatgacagccatgggcggcaggcttttaaaacagtggatcggccggccgctgcttaagcaggaaaaaatagaagcacggcttcaaatggtggaaacctttttaaaccattactttgagcgggaggatatccgcgagcgcctgaaggaagtatacgacctggaaaggcttgccggccgggtggcatttggcaatgtgaatgcacgtgacctcatccagctgaaatgctcgctacagcaaattccgggtatccgggcggtcatggaaagcttggaaagcccggaaagcaaaaaattggcggcgcttcttgacccgtgtgaagaactgacagatttgctcgaacgcgcgattgaggacaatcccccggtttccgtgaaggaaggcgggatgatccgcgacggctataacgaagagctggaccgctaccgcgacgcgagcaaaaacggcaagcagtggattgcaagcctcgaacgcgacgagcgcgagcggaccggaatcaagtcgctgaaagtcggatacaaccgcgtgttcggctactatattgaagtgacgaaggcgaacctccacctgctcgaagaaggccgctatgaacggaaacagacgttggcgaacgccgagcggttcatcacaccggaattgaaagaaaaagaagcgcttattttacaggcggaagaaagaatgatcgatctggaatacgagctgtttacggaaatccgggcacatgtaaaagaatttattcccaggctgcagcgcctcgcaaaagcggtcagcacgattgatgtgctgcaaagctttgccgtcgtaagcgaaaaacgccactacacaaagccggtattccgggaagacggcgtgctgaagattacggaagggcgccatccggtcgtggaaaaagtactcgattcgcaaagctatgtgccaaacgactgcctgatggatgaaaaccgagagattctgctgattaccgggccgaacatgtccgggaaaagcacgtatatgcggcaaattgcgctgacggtaatccttgcgcaaattggctgctttgtgccggcgcgcgaggcggagctgccggtttttgaccggatttttacacggattggcgcagccgatgatctcatttccggccagagtacgttcatggtcgaaatgcttgaagcgaaaaacgcgattgcaaacgcaacggaacgaagcctgattttatttgatgaaatcgggcgcggaacgtctacatatgacgggatggcactcgcccaggcgatgatcgaatacatccatgatgaaatcggggccaaaacgcttttttctacccattatcacgagctgacggcgctttctacagaactgggtaagctgcaaaacgtccatgtcagcgccatggagcaaaacggcaaagtggttttcctccataaaatcaaagaaggccctgcagataaaagttacgggatccatgtggcaaagctggccggcctgccggaacaagtgatttgccgcgccgaaaaaattctccatgcgcttgaaaaccaggataacggcgaaacgcagatgaaccccccggaggcggctgctgccacagagcccgcgcaactgtccttttttgaagagccggaaacgccgcgtcagaaaacggttgaagcaaaggaaagaaaggtgctcaagcaaattagggaactcgatttgcttgagatgacgccgcttgcggccatgaatgcactctatgagattcagaaaaaattaaaaaaataggtggtgttgtccgcgatgggaaaaattgcacaactggacgagttgctttctaacaggattgcagccggtgaagtggtcgaacggccggcatctgtcgtgaaggaactggcggaaaatgccattgacgcggaaagcacagttatcgaaattgatgtctgggaagccggtatggaaaaaatccgtatgattgataatggaaccggcatcgagcctgacgatgttgagcttgctttctcacgccacgccacaagcaaaatcaaaaacgaacatgatctgttccggattcgttcgctcggttttcgcggcgaagcgctcccgagcattgctgctgtttcccgtgttgagatcgtcacctcaaccggaaacgggcccgggacaaaagcggtcattgaaggcgggaaatgggtggcccgcgaacaggcaccgagccggagaggaacggaaattacggtcaccgatttattttttaacacgcctgcgcggttaaaatatatgaagtcgatccataccgagctcggcaatattaccgatgtggtgaaccgcctcgcgctcagccaccccgaggtgtctttccgcctccgccacggcggaaagatgttgcttcagacaagcgggaacggcgatgtgcgccaggtgcttgccgccatttacggcttaaacattgccaaaaaaatgattccggtacacagccaaacgcttgattttgaaatcaacgggtttatcgctttgccggaaattacgcgggcttcgcgcaactatatttccacgatggtaaacggccggtttatcaaaaattacgtgcttgtaaaggccatattggaagggtatcatacactgctcccgatcggccgctacccgattgtgttgatgtcgctaaaaatggatccggttttagtcgatgcgaatgttcacccggccaagcttgaagtgcggttcagcaaagaaaaggagctgtgccgggcgattacgggcgcgattaaagctgctttcaaaaagcaggaattgattccgtccggcatggtgcggcaagcagaaaaaccaaaacaggaacaggtgtcgttccagcttgaccatttgccgggaaaaacggaaccggaaactccgaaagctttctccgcgcctgttgcgccgcacccatcgccccggccggaggaaacggaaatggggcagcacgataaaagcccggatgcagaaccccatctcagcgtggaacagccggccgcagatttcccggcattttcaggggaaaatctggattctgtttttccagatgaaatccatgaaccggcgcgcgatggatttgatgttgaagaggcaagagggcaggacgcggcacagcagccggcatcccgcatcccgccgatgtatccgatcggccagatgcacggcacgtatatttttgcccaaaatgaaaacggcttgtatatcattgatcagcacgccgcccaggagcgggtcaagtatgaatttttccgcgaaaaagtcggcgaagtgaaaaaagaagtgcaggaaatgcttgtgccgctgactttagaatacgcaacggacgaagccattaaaattcaggagaacctcgatgcgctgaaagaggtcggcgttttccttgaaccattcgggcacaacagcttcattgtccgttcccatccgacatggtttccgaaaaatgaggaaaaagaggtcattgaggaaatgatcgagcatgtcctttctataaaaaaagtcgatattaaaaaattgcgtgaaaaagcggcgattatgatgagctgcagagggtccatcaaggcgaaccggcatttgcgcaatgacgaaatccaggcactgctcgatgcgctccgaatggcatccgacccgtttacatgcccgcacggccgtccaatcatcatccattattcggtgtacgaactcgaaaaaatgtttaaacgggtcatgtaactcccggatcgcgaaaccccttgatgatcaaggggtttcaatctttttaacgggtgtttgaccacaatttgaccacatttcaaacatgtttgagatcgttgtattgttcaaccttttactagcgtatcgataccatcttccactaaaggcccatcagcccgttaacgataagtgctttggataatacgagagggggtgaagttttttgttctgattcttgacttttgtcattcattgtgatgacgccttgtttagaatcgctgttcacgccatataggttccgtctttgattctaagaaaaagcctagagggccttttcctatctttcacaagcgatactatcatggtccctgtcttttgttttatttttgtcatacaatgcttttgaaacgtatggcttatagtgtgtctttccacctttgttttttgcgcttttacttcttgcaacgccgcctttgtaatctttattcaaggctttacagttggcataagtctttgcctttgccgcatcaacatcatgagaagcagcaaacgatactccgaaaattaggccggaagcaactgcgactgaaatgatttttctcactataattctcctccaagttcacttaaatgattttatatagtcaccaatgaaaaagatgttataacttccatatatacctaattcttgtagtggacggaacaacttcggtatgagcaattggataccatcgtgttaaagaatatagaatacatatctatcaaatagactgaggtttccatgcattcatccgattttcatctgcaaatgactttacagaggggcaacttcctttacatatacgatttggtcactgatttttattttgcttcatcatattaatttcgaattctgcgtctgcaacttttctatttacaaaaatgacaccattccgaagatctttgatttcctctttgacgcctgcaatctcaccgtggacatggtggacatccattgatagggcatcaatctttgcatctgtttcttcctggcggtcgcgtatggttctgacaatttgtcccagttctttttgacccgattctaagacttcaaacttattgttcagttctttttggccggattctaaggcttcaaacttttggttcagctctttttgacccgattccagtgagcttagcttcttaaggataagttccagcttctgatccattatcaatctcctttcaaatggttttgatgagcttcttcttcggggtgaatttctatcaccatccattatatattgcatttttaatccaatccataggaattcatctctgtcctgaaaatatgcgccggctgattctcatcttccgctggtgccgcattcgatgcggtatgacatctcatttgttttgcaaggcgcagattgctttcaatcacgggccgtacaagtccttttgtttcctcgtcgattgcaagcgccacgccggaggccacttttccaggatgcaacggctgacgggccaccatcacgacgacgtgcagaaaagcagcgactggtctttgttttaaggtattgggcggatggaaggaattaatcatggaaagagccgtctttgctttgtgcgagcattaccagctggtattcataaatcagtttgtccaataattggctttggcggattgtttccgggtggttcatgccgttttgtttggcacactgcatcaattgttcgcggaggatgaaaatattgcgggacagatgggcagaggcaagtatgagatactgattcgttttttccatgcaaacatccctttcggagaaaaataagaagattagaaaaacagttttgaagaaaaggcagcatgagcgtgttttggaggcggttgtgcttaagatggtttttttgcggagctggcaggcatatcgtttgaatcagggtcaatggcatgcctgagcaaaacgatatcttcatatatgctttttttcacagcctcatacgggcatttgtggtattcatctaaaagccgccctaattcaatgatgaaaatgatgcgttcgtcatttttaaccatacgaaaaaacctgccttacatagatcataatgattatccttattatatagtataaatggaccggatgtgaagcaggactttagccctatacacacttttttaaatattttttcgtaagtgaattttcaaggatgaataaaatcccgaaaaaagggaaactgtatagatgttctgtttgctgttttatggtacgatagagacggaaaaatccggggatttaaagaatgctgcaatctccggcataaaaggtagggtacgaatggcaaaacaaaaactgatcgtactgatcggcccgacagcatcaggaaaaacggcacttagcatccgcctcgcgaaaaaattcaatgctgaaatcatcagcggcgattcgatgcaagtatacagaggcatggatatcggcacagcaaaaattacgcaggctgaaatggaagggattccccatcacctgatcgacattaaaaatccggatgagtctttttcggttgctgaattccagcaactggtacgggaaaaaataagcgatattgcttcccgcggcaagttgcccatgatcgtcggcggcacagggctttacatacaatctgtcttatacgattaccgtttttcggacattgccggagatccggcataccgcgcggaacttgaaaagattgcaaggcgggaagggcccggcctgctttataaattactggaaaaaaccgatccggaaagtgccgcaaagattcatccacataatgtcagaagggtgatccgggcgttggaagtaggccatttttccggtaggacgatgcaagactacaagaaacagcaacaggatgaaccgctttattgtgcggcgctcattgggcttgtgatggagagggagaagctgtatcaacgcattaacgaacgggtcgatcaaatgatggaacgcggtttaatcgaggaagtgagaaagttgtatgacaaaaatttgcgcggtgtccagtccatccaggcgatcggctacaaagagctttacgattactttgacgggcgcatgacccttgacgaggctgtttcccgcttaaaacaaaatacaaggcgttttgccaaaagacagcttacctggttccgcaataagatggaaattgagtggtttgacatgacaaaagaggaagaaaaggaaaaaaaatttaaagaaatttccgctttcatagcaggaaagctacaattaaaatcgaatagtttataatatagagtatagccaggaacacgcgtgacttcagtcatgagatgctccgggcaccgaaccgcagaaactgcgggggctgcctgctaaaatcaccggagatccaccggcgtttgcaggaatctcgcggctttagtcatgagcaggttaaaatagagagaaagaggaggattcgcaatgaacaaagccatcaatattcaggaccagtacttaaaccaattgcggaaagacggtacggttgtcacagtctttttgatgaacggctttcagcttcgcggccaggtaaaaggctttgataacttcaccgtgctgattgaaacagacggcaaacagcaactcgttttcaaacatgcgatttcaacgttccagccgcaaaaaaatgttcaaatcaatttcgaggaaaattaaaacaaaatgtccggcagcttgccgggcattttaaatatgtgtactgttatccgcttctgaaacataaactgatacagatcattatttctcgggaaagcgcaaaaaccgacaatttcccccgccattttggatggtgctgattttcgaccggtgcggatttgaaaaacaaccggttttcttatgccggacaacaagtttttgtacgtgggcatttgtcacactcccggcccaatccgcgtatattgtctgtagaatgcgaggtggcggtgatggatcaaccgattcgtatgaaaaataacggccagatcaatattgtcctccatgcgggccaaagggaggccgttattccccagccgaaaatagaaaccggcaaaaaagatttatcagcagaacatgaaattttaaaagaaattgaagatgaacttggcacgctcgtcggaatggaagaaatcaaaaaaatggttaaagaagtttatgcctggatctatattaacaagaaaagggaagccgccgggttaaaaacgggaaagcaggcccttcatatgatgtttaaaggcaatcccggaaccggcaaaacaactgtcgcccgattgatcgggaaattgttccataaaatgaatgtattgtcaaaaggccacttgattgaggcggaaagggccgatctggttggcgaatacatcggccatacggcgcaaaagacaagagatttgattaaaaaagcgatcggcggcattttatttattgatgaagcgtactctctcggccgcggcggcgagaaagatttcgggaaagaagcaatcgatacgcttgtaaagcatatggaagacaaacagcacgaatttattttaattttggccggctattcaaacgaaatggattatttcctgagcctgaatccgggactgtattcccggtttccgatcgtgttcaactttcctgattactcggtagaggaactcatggatatcgggaaaaggatgctgacggaaaaagagtatacgctcagtttggatgcagaacggaagcttcgcgatcatctggcttttgtcaaaacaacgagcacccctgccagtttttcaaacggccggtatgtgcggaatgtaattgaaaagtcagtgcgcgcccaggccatgcggctgttaatgcaggcttgctatgaccgccatgagctggtcacgctgcgcagcagtgaccttgtttttccggactgacgcctgcatcctatgcagtttgcagcaggcgcttattttccgtagggaagcttaaatcggctttttcggccagatgtttcgcacggaaaataagcagcccgggaagacatttttaagaaaggtaagcccgggcataacagcgcccgggcttttttaatgggggcggtaaaaaagcgatatcgcatgaagccatgccctgtttcccaaaaaaagcgcctcgacatgttatacttgggcgttttttggtaagataacaggtatactggacggaacaggtgatgaaatggaaaataaaaaagaaagagcaattcttgtcggatgcgaatggagcggcatcagccacagccgttttgcctattcaatggaggagctgaagcggcttgtcgaaacggcgcagggggaagcggtgcttgaagtcgtacaaaaacgggacagggtagatgctgctacgtatatcggaaaaggcaaggtagcggaactaagggcgcttgtttcagaactgcaagctgatctgattgtttttaacgcggaactttcgccgagccagctccgcaatctccaggccgcggtggattgccgcgtgctggacaggacacagctcatccttgatatttttgcgacgcgtgcccgctcaaaagaagggaagctccaggtggaactggcgcaacttgagtatttgctgccgcgtcttggcgggcgcgggacggagctgtcgcggctcgggggcggaatcggcacgagggggccgggggaaacccagcttgaaacggaccgccgccatatccgccgccgcatttctgaaatcaaggcgcagcttgaaacggttgtccaccaccgggagcggtaccgcgaaaggcggaaaaagaaccatgtgtttcaaattgcgcttgtcggctataccaatgccggaaaatcgacattgtttaaccgcctgtctgccgcaaattcttatgaagaaaaccagctgtttgccacgcttgatccgatgacaagaaaagttgtgttgccaagcggttatacggctttgttgacggatacggtcggatttatccaggacttgccgacgacactgattgcggcgttccgctcgaccttagaagaagtgcgggaagccgatttgcttttgcatgtcattgacagttccaacccggattatgacaaccatcaaaaaacggtgcagcgcctgctttccgaactggaaatgaaccatctaccgcagcttgccgtttacaataaaatggatataaaagacagccatttcgtgcccaatgcacaaaacagcatcatgatcagcgcgaaagacgaaaaagacatccaccggctgctgttggaaattgaaaaacaagtgttggccgaaatggtgccgtatcgcgcgcttgtcccgcaaacagaaggaaagctgctttcagttttaaaaagtgataccattttaagagaactaatttttaaagaagaaaatgaggcataccagtgcaagggatatgcgcttccaggccatccggttctgggcgcgatacaacaatatgctgaataaaaaccttgcgcgcgggtgcatgcagcgggttgccttgcatgcaccccatattttgaacggaaaggtgtagaagatgtaccagtatttgactcatggtgccaaactcaggcaaatggcagaagaggccgagcgtcaaattcgcccggtccacagcgcaatagaaaaacgggcggaagcgaaccagttccgcgttttgcaaagttttcaaaagtataaagtgagcgagtcgcatttttatccgtcgaccggatacggctatgatgacgccggcagggaaacacttgagaacatatatgccgatgttttcggcgcggaagccgggctcgtccgcccgcaaatcatttccgggacacatgcgattacgattgcgcttttcggcgtcctccgcccgggggatgaattgctatacataaccggaaagccgtacgatacgcttgatgaaattacaggggtgcacggtagtggcaacggttcgctgcaggagtttaacataacctataattatgtaaacttgaaggaagacggcacggtcgattttgaagcggtaagaaaagcgatccatccccatacaaaaatggttgcgatccagcgctcaaaaggatatgcgtcaagaccttcgtttacagtggatgagatcggggaaatgatccgctttgtaaaagaaatcaagccggatgcagttgtgtttgtcgacaactgctacggcgaatttgtagaggagaaggagccatgccatgttggcgcggatttaatggccggttcgcttatcaaaaatccgggcggcgggcttgcgaaaacgggcggctatattgtcgggaagaaaaaatgggtggaaagctgcgcttacaggatgacatctcccggaattggcgcggaagcaggagcatcgctttacagccttcttgagatgtaccagggcttctttctggcgccgcatgtggtggcagaggcattaaaaggtgcggtgtttacatcggcaatcttggaaaaatccgggatgaatacgtatccgaaatgggatgcgccgaggacggacctcatccagtccgttgaatttggcgacccggacagcatggtcgccttttgccaggcgatccagtttgcttcaccggtgaattcatatgtgacgccatacccgagtgatatgcccggttatgcggacgatgtcatcatggcagctggcacgtttatccagggggcaagcatcgagctttccgccgacggcccgctccgcccgccatacaccgcctatgttcagggcggccttacgtatgcgcatgtcaaaatggccgtcctgctcgcgctcgaccggttgatggaagaaaatcttgtagatcccagttgaatttttccctgctttgatctacggtcggctggatttcaaccgggcacaatggttcgcccgtttagaaccgccttttttcaatgcggccagttgctggttgtgttataataacaggatgatatttgatgaggtgatcgcatgaataagaggccgcatttgcttttaattgacgggatggcgctccttttccgggctttttatgccactgccgtgacggggcagtttatggtgaattctaaagggatgccgacaaacggcgtgcagggctttttgcgccatttgcttttggcggctgagaacaaaaaaccgacgcatgtggccgtttgctgggatatggggagcaaaacgttccgcaacgacctgtacggtgaatataaagcaaaccgggacgtcccgccggttgagatgattccgcaatttgacctggcgaaagaaacagtggaagcttttgaaattccaaatgtcggagtggccgggtatgaagcggacgactgtcttggcacccttagcagccggttcaaagacgaggcggatatttccattttgaccggcgaccgcgacatcttgcagcttttggatgaccatgtggaagtccatctcctccaaaaagggttcggaaattataaaacctatacaaaggcggcgtttatggacgaatacggggtgacgccgcggcagtttatcgatgtaaaagcgctgatgggcgatgcaagcgacgggtatccgggtgtgaaggggatcggtgaaaaaacagcgtttaagctcgtcagccggtttggaaacatcagcggcattttggggcatctcggggagctcaccccgtcgcagcagaaaaaaatcaaagcgggattggagatgctgcacctgagcagaaaacttgctgaaatccgttgtgatgtgcctgtggctttttctttggaagaagcgcggtttggccagattcctgaaacgtttatggaactgatggaggaactggaattaaaaatggtaaaacgccatttggttacagcgcggataaacgcaagcttcatttcttaaccactttgcccggtttaattggggacggaaagtggaaaaacagcattcaggacaagaatgctgtttttcttctccgttttgcgattgtcagatttttgtattggactttttcgcgcggttttcaagggttgtttttgggtccggcgcgaatgccgcatcctgtgcgattccttgcggcgtaacggaatttgccgctttaccgcggtttgtattgtcttttttagccatcctgatcacctcttgttatagcatgcccaaattcggggaaattttgataaagggatccccgggaaagtcaggcgtgccgcaatggataaatgcacgtgcaatgcggatgggaaagctggcggaaagaaagaagggataaagatggaaagaaaacaactcatccgggaagtggatgaaatattaaagacgtattgtgaaggctgttttttaaaatcgcatttccggaaaacacgtgggaaaaaatatgcccaccagttttgcatccggcaatgcacggtaggcgaaaagctgaaaaaatacggcgaccggttatcgtgacgggtgttacaaaatgcgggaaacaggcggcacccgaaaacggttgcccgtcttgccgtattaaatcgaacaaagtcggctcagacaacaggcgtggcggaagacatcgcagactgtaaacagtatactgatgcaacaaccggaaaaatgccacaatccggtattgtgaggacttacacaaatgcagaaaaataaaaggctggcataaaagccagcctcgttgcattctatgatttatgaaagttttgttacattcgctgcctgaggtccgcggttgccttcaacgatgtcgaaagaaacagcttggccttcttccaatgttttgaatccttcaccttgaatagcggtgaaatgaacgaaaacatcgtctccaccttcaacttcaatgaacccgtagcctttttcgttattgaaccattttactttaccgttttgcatttcttaatcctcctaaatcaaaagcacgttcgtgccaaaaaatgttgcattaaacagatgaaaaaccgccatcaaggtctgggaaatcacttgtttaatgttataattaatatactccatccggtatggatagtcaagacaaacgaatcaaaaatgagggaaaattgttgtgaattcttaaatttgcaagcggtttaaaactggcgcagcttttttcaggaattcttgtacatcatccgtgattatagtaaactgatggtattgttattgtaccggcagactcaatatttgttgtaagaatgggggcccgtggatgccgacacctagtatggaagactacattgaacagatttttattctgattgaaagcaaaggatatgcgcgtgtttctgatattgcagaagcgctttccgttcatccttcatccgtcacgaaaatggtacagaagctggataaggatgattatcttgtttatgaaaaataccgcggactggtcctcaccccaaaaggtaaaaaaattggaaaacggctcgtcgaccgccatcatttgcttgaacagtttttaaggatcatcggggtcgacgaagaaaatatttatagagatgtagaaggaattgaacatcacctgagctggaattccattgaccggatcggagaccttgtccaatactttgaggaagatccgggccgggtgaacgacctgaagcggcttcaggcacaaaacgaggattgaattttccggcctccctgcccttgaaatgggtgctggttcctttttatgcaccggatgatggggcatgttgcctaaaaggctgtctgccggcacgcatcaggatttagaaccctccctgcttgatgcaagcagggctctttcccgccagccggaaaacaaacttcgcatggcgcctttatgcagaaaattagggctagagccaaacgattttccggtatgggtgaaaaaatccttttttcaggtgcaatgggctacaggggtatgtagaatagaagatggaagcagatttttgatgaagcggaggatttgacattgccaagccattcgattggaaagacggatattgatattgcacagcatgcttcgctgaaaccgatcaaagaaattgcggaaaccgtgcagcttgcagaagaagaccttgaatattacgggaaatacaaggcgaaaattacatatgaaaaaatcaagcagcttaaaaccaaaaaagacggaaaattatttcttgtcacttccatcaatccgacgccggctggggaaggcaagtcaaccgtcacaatcggactcggcgatgcattaaaacagctgggccataaaaccgtgattgccttaagggagccatcactcggaccggtcatggggctgaaagggggcgcaacgggcggcggttatgcacaagtcttgccgatggaagagatcaatcttcatttcacaggcgattttcatgcgattaccgctgccaataatgccatttccgctttgctggacaatcatatccaccagggaaatcgattgcagattgaccagcgccgcattgtctggaagcgggcggtcgatttaaatgaccgggcgctgcgccatgtggtcgtcggtctcggcggtcccggccagggcgtgccccgtgaagacggatttgacattacggtggcttctgaactgatggccgttttatgcctggcggaagatctcgaagatttaaaaaggcggattgcgaacatcgttgtagcctacaattacgaaaagaaacccgtgaccgtcggtgacctcggaatcgaaggcgcgattgccttattgctgaaagatgctttgaaaccgaatcttgtccagacgatcgaacatacaccggcgcttgtccacggtggcccgtttgccaatattgcgcacggctgcaacagcgtgatggcgaccaaaaccgctttgaaactggccgattatgtcgtcacggaagccggctttggtgccgatctcggtgctgaaaaattcctcgacattaaagcgcgggcagccggcttgaaaccggacggcgttgtgattgtcgccaccatccgcgcattaaaaatgcacggcggggtgtcaaaggaagatttggcggcagaaaatattgcggctcttgaagccgggcttttaaacctgcaaaaacatgttgaaacgatcgcttcattcggtctgccgtttgtcgttgccatcaaccggtttatatcggacagtgatgcggaaattgctgtcttagaaaattggtgcagtgaacgtggcattcctgtgtcgcttacggaagtgtgggaaaaagggggcgcaggtggcatagatcttgcggccaaactgctggaagccgccaaacagccacatacattcaggccggtttacccgcttgaatcaaccattgaagagaagatagaggcgattgtgcgtcaggtgtatggcggccgcggtgccgaattttccgcgaaggcgcaaaaacaaatccgcgaatttgaacaattcggatggggacatcttcctgtttgtattgcaaaaacgcagtattccttatccgatgacccgcacaaaacgtgccgtccgtatgattttgcgatccatgtccgcgaacttgtcccgaagcttggcgccgggtttatcgttgccctgacaggagacgttctgaccatgccgggtcttccgaaagaaccggccgcttaccggatggatgttgatgcggacggccgcgcatccgggctcttttaaacgggggacaggcgatgtttgacccaactgcttttgaaaatatgaagactgtattcgaaggtgctgcctatgagcttgatttacgaggggaagcatccatcaccggaagaaaagacctggtcgacctggcggaaatgtcccgggaataccgcattacgcttcagcttccggaatggcaggaagcaagcgtaacgatctgtctttcggcttcgctcgggcagctggcggcggaaatactggatctcgcgtccggcgccaaagcgggtgccagtgcggccgtaactttttcctggaaaaacagagaccgatccgctgattataaacagattatcttttccgcatggggaaacggcaaccggcgccgcatcgaggaaaggactgtccgctcatcacgctcgggtgtaaccgaagaagttgccatcgattttgcccggctgataacggaagatttaatggatgatttgcttaagatgcccgcagatgccgtgaagactttgcgccggatgagggtctaacaaaagctgcatgctctgtcgtgcagcttttggcttgcttgcccaaaaaacatgataaaatgaaggcaaagaaaggggcatttatgtataaacatccggttcttttacagattgaactgttcgcccgcgctttccacagcggagatgcttccggtcatgactggcaccacattaggcgtgtccgcgggcttgcactctatattgcggaaaaagaggaaaaaggtgatcgatttatcattgaagctagcgcccttttgcacgatattccggacgtaaagctgaacgcggacaaccagaaaggggcgaaaaaactgaaggcctttttaaacagcctgccgctagcggaatatcaaaaagagcaaattcaaaatatcgttgcaagcatttcttttaaaggcggcaatgaaacagaactgttgcattttgaggcaatggctgtccgtgatgccgaccggttggatgcaatcggggcaattgggatcgctcgcgcattcgcatacggcggaaaaaagggtcagccgctctatgacccggaactgccagtgagaaaacaaatgactgaagaagaatatcgaaacgggaaaacttcctcgatccatcatttttatgaaaagctattacttttaaaagataggctgtacactgagacggcgaaaaaacttgcagaagaacgccactactttatggagcagtttttacaggaatttttcaaagaatggaatgttgaacgatgaaaatatttcaagctcagggactgacaaaatcttacggggaaaaagtgctgtttggtgatctttctttccacattggggaacaggaacggatcggccttgtcggcgtcaatggcaccggaaaatcgagcctgctgaaaatcattgcgggacaggatgaagcggatagcggggaactgagcacgccgaacgattataccattggttatttgccgcaggagcctgaactgaatccggccttcacggtccttgaacaggtatataaaagcgagtctccaattatggcgcttttacgttcctatgaagaggcgctgcttgaagtcgggaaggatccgggaaatgcagacaaacaggatcgattgttccggctgcaaaaagaaatggatgccggcggtgcatgggaagccggcgccaatgcacagacggtcctttcaaaacttggcatccgcgatttggacagaaaaatttcgggattgtcaggcggacagaaaaagcgggtcgcccttgcccgggtattaatggaaacacccgatttgttgattttggatgagccgaccaaccatctcgactatccggctgtcaagtggctggaagcatttattgcaaaatatccccgttctgtcctgtttgtgacacatgaccgctatttcctcgaccgggcggcaaaccggattttcgagcttaatggtggaaaactgtacagctacaaagggaattaccaggattttatggaagcaaaagcgcagcgggaagaagcgcaactgcagcaggaagaaaaacggaaaaatttgtacaggcgggagcttgcctggatgaagcgcggggcaaaggcgcgttcgacaaaacaaaaagcaaggatcgggcgttttgaagaactggaatccagcctcggtaaaagcccccggcagcaggaagccgatatcgctttgtccggcagccgcctcggcaaacaggtttttgaactgcagcatgctaataaagcgttcggttcagagacgattctaaaggatttcaacctgctcgtaaagccgggtgaccggatcggcatcgtcgggaaaaatggaagcggaaaatcaactttgatgaacattctcgctggcaggattccgctcgattccggggaacgcctcaccgggcagaccgtcaaaatcgcgtattaccgtcaggaaacgccaggcatgaatgaagataagcggatgatcgagtatatacgggaagcgggggatacggtgacaacaaaagacggggaaacgatttccgccgcgcaaatgctggaaagatttctttttgacatgcacacgcacggcaccccggtcagaaaactgtcgggcggcgaaaagcgcaggctgtatttgctcaggcttctgatgtcgcggccaaatgtgctgcttttggacgaaccgacgaatgatctcgatacggagacgcttaccgtgcttgaagattatatcggagagtttccgggcgtcgtcatctcggtttcacacgaccgctattttcttgataaaaccgcggagcagctgcttatttttgaaggcggcggcaaaatcagccgctttttcggccgttacagcgactacctcgaaatcgcgcatgaaacgccggcacaggaggaaaaaacggatgtgccaaagcctaaacgggaaccgaaacgaaaaaaatggtcttatcatgaacaacgggaatgggaagagatagacgaaaagattgaagcatgcgagcaaaccattgccgaactgaacgaacaattggaacaagccggctccgattttgtcaaagctcaggaaatttcaacagcgctcgaagaagaaaacgaacggctggaaggccttattgaacgctggagctatctttccgaactgcaggaaaaaaacgacaactaattctgaggaaggcgacccgttttttgccggaaaagcgtgacagttggtccgtcgctttccgggctggaggaataggtggtagccgggaacatgctttttgaaaggaaaaaagggtgagcctacgaacgcgcaaaagatgttttccattttcaagatacgcttgatatttccgaaaagaatcaactcattcgtgtatccactgtgattatgttaaaatgcaagtagactggaatgggaaaggcggtgtggaaatgaaaattaaagcgattgaaccaacgccgagcccgaatacgatgaaagtcgtattgacggaagcactgccggacggcgcccgcagcaattataagaaagggcaggaagaaggggtgccgcctgtgatccgccgtattcttgatatcgaaggcgtgaaaggcgtataccatgttgcggattttctcgcggtggagcggcatggtaaaacggactggcaggacattttgccgaaagtgcgtgaggtgttcggggaggcggaaacagaaaccggaaacagccctcgtgccaatgagcatttcggggaagttcaggtgtttgtccagatgtttaaaggcattccactccaggtaaaactgacggacggggaacaggaaaaacgttttgggctgccggattattttgccgaggcgctggccgctgcgcaactggaaggcgacaattatgttttcttgcggaaatggaaagacttcggcgtgcggtacggagagatgcaagagatcggtgcggaagtcacagaagaaatcattgccgcttatccgaaagaaaggctaaaccggcttgtaaatgaagcgcagcatccggaacaggttcccgctgccaaaaaaagattgaaattaacgcccggcatgctggaaacggatgactggcgcaaaaggtaccggctccttgaacaaatggaagaccctgatctttccgacttgcctgttcttgaaaaagccttgggagatgaaaagccatcgatcaggcggcttgccgttgtgtatttgggcatggtgaaagacaagcgggtactgccgcttttataccgcggtctgcatgatgcgaatgcaagcgtgcggcggacggcaggcgactgtcttagcgatctcgggttcaaagaggcatgcggggaaatggcaaaagcgctcaaagacaaaagcaaaattgtcaggtggcgcgccgccatgtttttatacgaagcgggtgacgaagcttctctaccggctttaagggaagcggaaaacgaccctgaatttgaagtcaggctccaggtcagaatggcgattgagcggattacaaaaggcgaagaagcaaaaggctcggtctggaagcagatgacagaagcaaggcaaatccagccataattagggcttgctgaacaaatccgatgctgagtttgtgcccaatttatctgcaacctctgtctcaaaatatagaagaatccttttgcgaaaaggggtgatttgatcttctccggacgttgaattggctttcgagtgcaggcatttccctggatttgttgtaaaacccttgcatttaaatggttgccaaagctatcaggatccttgccaaatctaggaatttcgcttattcagcaagccctaattaaaggaggacatcaacatgtcaatggcatatgaagaatacatgcgggcgcttattaccccgatgagggaagaattgacggcaaacgggtttacggaactgcgtacaccggaagaagtagaggcctatatggaaaaagcggaaggcaccacgctggttgtcgtgaactcggtgtgcggctgcgcagccgggcttgcgcgtccggcaattgttgaggcaatccggacggctgaaaagaagccggaccatcttgttacggtatttgccggccaggacaaagaagcaacggcaaaaatgcgtgagtattttaccggcatcgaaccctcctccccttctgtggcgctgcttcaagggaaagaagtggcccattttatcccgagaagcgatatcgaagggcatgaagtcgaagaaatcatcgaaaatctgcatgctgcttttgaccaacactgcgcataaaattgcggccccgtttgcatcattccggttgcaaaatggggcctgttttttctgtgtaaatattatataataaatacatattcgaactgttgggatatggaggggatcacgtgaaaaactggctgaaaaaatcaatggttatccttgtttctgttttaacattcggccttgtccccccttcccatgcaatctggaatcatctctataaaactggcaatgaaacggcggaaacgacttctgcttattccaatcggacggctgccacaagccgcaagattgacagtgccgcgcttgctcggtcattcgttgaagatgcagaaaaacgggcttatctgaaattcggggaaaggatcaggcctgttattgaagacgagttccgtgctgccgttttgccaaacattcaaaccgccatcgcggaaacgctgcaggaatacccgcaggacaaactaccgctgctcgctgtttcagaccagccgagtgcgggaaccggtgaaaaaatgtttcatatttacaatacggaaacaaataaagacatcatccgtttccatgtccggcgcgaccatccgcccggcgacggctactattttaatttccattaccatgtagcctttgaccatttccaaacgcaccgccaccttggcaccatttactggggcaaaaacatgccgccgcaatggatgaaaggataaaggcgggttgaagaacgcttgtcgcggcagcagctgacagcgctgcaacggataaaagactaaagcggtgtggaagacggacacctcatccagtcgaacatttcatgcgctttttgcaaacgcagtgaatacagcaccggcagaaggatgtaaaatgagcgaaacatggcttctttgttgccggccgcaaaaaggaataattatgcaaatggatggttttgccccattgtaaaaactggatttcaatttatataacgcaattttccaggatagaaacccggatatttgaatgacaaaggatggaatcatgatgaaacaatatttagatctttgccgcgaagtgcttgaaaacggcgtcaaaaaagatgaccggaccggtaccggaacgatcagcgttttcggccatcaaatgcggtttcatctggaggacggttttccgcttctgacaactaagaaactgcatttgaaatcgattatttatgaactgctctggatgcttgaaggagatacgaatgtaaaatacctccaggaaaacggcgtccgcatttggaatgagtgggcagatgaaaacggcgacctcggcccggtttacgggaaacaatggcgttcatggcaaacccgggacgggcggatgatcgaccagatcacccaggtcattgaacaaatcaaaaccaatccggattccaggcgcctgatcgttaacgcatggaatgttggggagattgacaggatggccctgccgccgtgccattgctttttccagttttatgtggcaaacggcaagctgtcatgccagctgtaccagcgttcggccgatattttcctcggcgtgccgtttaacattgcttcttacgcgctgcttacgatgatgattgcgcaggttacggggctggaaccgggggactttgtccatacgcttggcgatgcccatatttacttgaaccatatcgaacaagtgaagctgcagctgacacgggagccccgcaagctgccgaaaatggttttgaatcctgaagtaaaagacattttctccttccggtacgaagattttacattaaaagattacaatccgtatccgcacatcccggggaaggtgagtgtatgatttcctttttatgggcggaagatgaaaaaggcgtgattggaaagaacaatgcgcttccgtggcatcttcccgaagacttgaagtattttaaaaacataacaatgggtcatccggttgtcatgggaaggcggacgtttgaatcgatcggaaagccgcttcccggcagaacgaatattgtgatgacgagagacccggattttaaggcccaagactgcgtcgttgtcgcaggcaaaacagaactgttaaaatgggcggatgcacatggcggtgagatttttgtcacgggcggcgcggagatttttgccctgctgcttgaggaagcggaaaaattgtaccggacgaaaatacatgctgacatggaaggcgatacctattttccgcctgttgactgggaggagtgggaaatggcttccagcacaaaagggataaaaaacgaaaaaaatccttatgactacgaatttcaagtatttgtacggaaaaggtaaaaaaacatggaaacattcccatggttttttctctgtgccatcagacataaaataaaatcgtgaagtacataaacgcgcttccggcaatgacaaagatatgccagatcgcatgggagtaaggaaggtttttccatgtgtagaacacggcgcctaccgagtagcagatcccacctgaaaaaaggagccagaatcccggagccgtaagccctttatacaaaggctcaatcgcaatgaggatcagccagcccatgattaagtaaagcattgtggacaataatttaaagcggtgaatgagaaaacattttccggcaatgccaatggcagaaactccccatacgaccgaaaacagtacccatcccaaagtgccatgcagtgtaatcagcacaatcggcgtatacgttccggcaattaacaagtaaatggcagaatggtccagaatcgcgagaaatgttttcactttcgtccagtaaaagctgtgcagcagtgtggaaaacaaatacaaaagcagcatggaaaccccgaaaacaagaaaacttcctagatagagcgggttattcttttctgcggcgaaaacgacgagtataaccatcgccggaatgctgagcagaaaaccgatgccatgcgtaacggcattggccagttcctgtttccaggatgaaagcagtgttgaagttgtcaaaaatttaaaccaccttcgtctttaagcttctctttattatagggttttgcggggcaatctgcaatggaaacaacttgcgtctttagcgggtgcaattttatgcattcatcagcagaagatcccgtttttcatgttataatgggtacattgtaaattcagaaaggctaagtggtgtcaaaaatgaaaaaatggttcattcctcttctcgcttccgttgcgcttgctttatcgggctgttcacacggcataaccggcctgttgtttaaaccggcaagcaacgaaaaaaagatggtgcccgttccgctgcacatcgtctcgatcggggactccctgactgaaggcgtaggcgacagcaaagggcgcggcggttacacctattacttgaaaaatgaactggacgccttaaagggtgtgaaaaaaaccaccattgccaattatggcgtaaaagggaaccggaccgaccaattgcttgcccggctccaggatgaaaaaattcggaagtccatcaaggattcagatgttgttatgattaccatcggcggcaatgatatgatgaaagtgctccgtgaaaatatttccaatttaaacaagcaggagtttgaggcggccattccagggtacaaacaacggctcgatcaaattttccgccgcatccgcgcgatcaatccggatgtaaagattgcgctcgtcgggctctataaccctttttcgaagtggctgaccgatataaaagaagtggaccaaatgcttgcagcctggaatgatgccagcaaagaggtggcatcgcgctataaaaataccatttttatcccagttgcagatatttttgagaacaacgaagatgaattgctttatgacgatcatttccatccgaacgatgaagggtataaacggatgtcgaaacggatttaccggtatctcctgaaagggaattttttggggattccaaaatagcaaagtggtaaaggaatgatgcttgcgtgaaaagaaacccatggaaaatcgctttttttgcactggcttcagtggttgtggcctttgtacttgtgctttccttttttctttttgtgccggatggccgcgtgcccaaaccggaaaaaaccggaaaaacgattgatttgcgggtagagacaaacaaggcggacttaacggcgctcattaaccgttatttgcgggaagaaaaaataaaagggaaagtgcttttaaatgatgaagtcgtctactatggaactgtcggggtcttttctgaaaaaatgcagtacaagatgacgtttaagccgaaagcgttaaagaacggggatctcgttttaaaacaaaaatcggtatccctcggttccgtccatctcccggtatcctatattttacaattcgtcaaaacgacctaccatctgccgaaatgggtgatcatccagccgggcgaaaaactggtgtatgtccagctgcaaaatatgaagctggaaaacggcgccaaggtgaaagtcaacgaatttgatttgcagcatgatgacatctcgtttacacttggatttccaaaataaagcaaaaagccggcctttaaaagccggcttttcaatatgccacagaaggtttcgccgccgcctgtgtacatgatacggattttaaacgatcttgacgcggacgtaaacggcaccaaaacacttgtctgggcgcattacacgggttttaaacgatccttaaccctttcggataaaagtttttcaaaatgccgcccgcttctttgctccagccgagcggaaaaccgtccaccgtgatcaagatccagccgcggttctcgcttgttcccggtagtgtctccccttttaaatagcggatgcattcactgctttcggcgcgaaggtccatccggtgtttgcattgtccggctttcagggaaagcgcgagcgcgtgattcggttcaaatcgattttttttgaaagtaccgagatgcaggccgcaccggacaagatggagcccctttaactgcgggcagttaaaaggcagcaggaaaagctcgtttttatacagaaaaaaggagcgcctgcccgggtcaaaatgctcgagggtgtttttggcaaaggttgtccagtctttttcctgttgctttgaaagcttcatgcccttttcaagcggcaccttttgccccgtttcctccgcgtgtttgcgcatttttgcagcaaaatgtccttcgccttttaagcggtgcggccataaacgcgccgcattggacaaatctttccgcttttctgttgcccattccggctttcccggtccaacgccgtgttcatggggaatcggcaccagtgccatgtcttcatgccgcgccaaaaaagcttcaattgtctgttcgttttcttccggagaaaaggtgcaggtcgaataaacaagggtgccgccgggctttagcatcttccaggcatgctccaagatcgtgcgttgtttttgcgcgcacgcttcgacatgttcctggctccagaaacgcgcggcttcgggatcttttctgaacatgccttccccggagcagggggcgtcaaccaaaattttatcgaaatagttttcgaaatgccggctcagtttttcaggcgtttcgtttgtcacaacggtattggagaacccaagccgttcaatattttcagaaagcgcgcgcacccgcttcggatggatttcatttgcaagcagaaatccgttttcgccgattccagatgcaatttgcgtcgatttgccccccggcgcggcgcataaatcaagcactttatcgcctttttcaagtccgagctgccctgcgataaacatcgcgctcggctcctggatataatagagcccggcggcatggtacgggtgttttccaggcttgtctttttcttcatcaaaataataaccggaggcaaaagggatgttttccaaatggaaagggttgtgcgcatgccattccgtttcgctcacttttgccggattcaggcgcaatccggatgtccgcggtttttcataggagcggaaaaaatcatcggcttcctttccaagcagcttccccatcttttccataaaggtttcaggtaattccaatcatgagacccctttccgttaaaatcgccgctatgatccattataatgaaatcggggcttgcagtcacgaaactggatgaaaacaacatcaacaggtaaaataaaaaataatcttttataaaggggggagccgcatggcagaggaaaccgcgatttttgccggcggatgcttctggtgcatggtccatccttttgaccaattgcccggcattcaaaaagttgtttctgggtacacaggcggaacaaagccgaacccgacatatgaggaagtgtgctccggtgcgaccgggcatacagaagctgttgaaattacgtttgatccggaagtttttccttacgaaaagctgcttgacatttactggcggcaaattgacccgacagatgcaggcgggcagttttacgacagggggggctcttaccggccggttattttctatcaaaacgaagcccagcggcaggcggcggaagcttcaaaaaaacggctggaagagagcgggcggtttaaaaagccgattgctgtcacaattgaaccggcttccgccttttatccggcggaaagttaccatcaggattattaccggaaaaatccgacccattacgaggcttaccggcaaggttcaggcagggccgcatttatccgcaaccattggagggatgaacatgaaggatgaaaaactgacgcctttgcaatatgaagtgacgcggaaaaacggaacggaaccgccgtttcaaaatgaatactggaacgagttccgcgacggtatttatgtcgatgttatttccggaaaaccgctgttcagttcaaaagataaatatgatgcaggctgcggctggccgagttttacaaaaccgatcgatgccggccaacttaccgaacggcttgatacgagccacggcatgattcggacggaagtgagaagcaaggcgtctgacgcgcatttgggccatgtgtttccggatgggccaggccctgcgcatcttcggtactgcatgaattcagccgcgatgcgttttattccgaaagaaaagcttgaggaagaaggatatggggagtatcttgcgctctttgaagaaaaagaataagtcggctgggcggatgcacatacaaaacgggcccgtatcccatacgatgcactgtacagaaaaacagtttttttgaggagtgaatgggatgtattacggccatgaaggtgcttaccctgcatatgacccctgctgcggctacggatacggttatgggtctggttacggatacggttccggttacggctggggctttgcaggacacagaaacggctttgctttaattgttgtgctgtttattttgctgatcattatcggcgcatgctggatcggccccaattaaaaatgaaaaaagcccagggctatgccccgggcttttttcgtgtcccttttatattttaaagtttccgatcagcttgcgcaggttttctgcctgttttgacaactccgaggctgcggctgtgacttcttccatcgatgcagacccttcctcggtacttgctgcggtcatttccgtatttgccgcggtattcatggcaatcttgctgacggcatcgaacgaattggcgacatcgacagaaagtttttgcgttttttcaatttgggcggccatgtcaataatgacatttgtcgtttcattcgtttgtttttgaatgacttcgagcgagtgcatcgtttcattggaaatttgcacgccggaagtaaccgcctctaccccttcctgattctggccgataatggtgctaatttctttttggatcgaacgcacaatattcgtgacttcctgggcagcagactgggattgttcggccagttttctgacttcatctgctacgacggcaaagccgcgcccgtgctccccggccctggctgcctcgattgccgcattcaatgcaagcaaattggtttgtttggcaatcccggtgatcgtcataatgatctttgtaatatcatccgacttttcaccgagcgcctctaccgttttgctcgtatttgtcatgatcgcttcaatgctcttcattttgccggacgtttccataatggaccggctgcctttttctgccgattctttcatatggagcgaagcctgttttaccgtttccgcctgccggaaaagcgtatcgaccacttcttcaagcgacttcattttcgataaggatgtatccatcttggaagaagtttgttcgctgtctgccgcgatttcattggctgtttccgcaatcgactggatcgttttcgatgtttcttcagaagaagcgagcagttcttcgcttgaggcagagacactttccgccatcgcggatacttcttttacaagccgggcaatgccgtctatcagctggtttgtatctcttgccagttttgccagttcgtcattggacgtcacttcaatccgccttgtcaaatccccgccggcatctgcgattcccaaaatcgaccggctgatttttctcgtgctcgatttgatgtttttcgttaggctgatgctgagcatgacagccagcacgatggcaagcaaggaaagggtgacggttacgatccgcgcaatcaggacggaacgatgcaagtcgccgatccggctttctgatgcctgtgtggtgcttatcagcaaatcatggatgctgcttttcaaatttttcatgtagtcggatgcctgggaatccttcacttgtgcaaccgcttcttgttccgacccgtactgccttgcttcgacaacccggtcaactgttcctacccagaaattataggcttccgaaattttttcgagtttttggctctgcaaccggtcatctttcagcattttttgcaagcggcttaacgtgctgctggcttcctgtttcccctggtcatacggccgtaacgcagcttcatttccggaaatggcgtaattcagggcgcccgtttcaatttcgccggtctgattgagcaggctttggacacgatcgtgcacggcgaggtcatgctggacaacatgattgatttcattctccagctcgcgcatgtttatgtatgaagtgacggttaatacaatgagcaagacggttaaaaccccgaatgaaatcacaatttttcccctgatcgtctgcaaataataaaggggaagccgatgcagctggcggttcggacgggaatttttccgtttctcgcttttttgctttcttattgcaaaaatgttccttttattcaatcaaaagcccctcctttttaccctgtgaaccgcaaatcatcatctatattttaaacatgttttctatctttttctagttttttgtaaaaacttcctcttcccgtaatgccaccctttctactttacgcgggggagacgatccgctatattggagtaaaaatcattttgggggatacttatgaaatctttttaccagtttttaatgagatatagggatccgcatctccgtgacgagttgacggtttttgccaatggggcatacaatgatcacagttttccgaaacattcaaccaactatcatgaaatcagttcctatctcgaattaaacgggcattatatcccgtcaatgtcggtttttgatcgggcatgggagatttataaaggcgaaagcaaataaccggccgaaaattgtgctgttcgctttttccggagcgcatgcatagaatgaagtaaaacgtgtttcgttttcaaggagcatgaaaaatggatgcaaaagcgccgaagtttcaagttggagatacagtggtcgtaaaagtatacgggacggtgggaaaaattacggctgtgagacagctggaaggagggtatttctatgtggtcaatgaccgggaaggcctcctagccgaacaaagcctcgcccgcctggaagaatatgacgggattctgtataagaaagaggaagtcaatatagaattgaaattttttatcggggatattgtaaaagtaaaaggctatggcggcgttctttttaaaattgttggtttccgcacggagatttggcggtatgcagaggatgcatgggaagatgtgatttatgaaatggtcagcattccaaagggcgaatggcttgaagcggatgaagaagaacttttgttaatcgccgatgccgggcaggccgattcgtttgtcagccgttatcaatttttttacccgatgaaaagcagccccctgtaccagcttgtcacttccgacttgaaaacgcaggaaaaaatcgaccgcctgctcgatatgtataatgattatacgctgctgttaaacctgtttggtgatgaggcgtacagagccatgcttgaggcggtcaaaatgcaaatccaggttctttcggcgcacggcggcccggattagtttagcgggtttggcatatcaggccgtacggggtcatatttatatcaacaaacagaacaaaacgcggggtggctgcgggatgaaaaaagggggcgtttttaatggagaatatggatgtttatattgatacagaggaaatcgccgcattcttttttaaagagctcgtgaaaaggggatttgcgccccgtgaagaagaactggacgaaattgccgatatcacttttgaatacttgcttgcaaaaagcatcatagacgaagaatatgaagacgattccatatgaggcgatctgtttgcaggccgtacagggaaaggtgcagcatcggtatccgggacagcctttttcggtcccgcacgaaatagcacttgatgtcccgttgaatttgccttaaaataaaaagagaaatcgcagggggagaaacctgcgattttttttggcaaaggagcgggatgcggacggttgtgcgcttaacgggaatgtgcttgctttttccatcgcagaaagatccggatggggcattcatgccgcttcttttgcagtaccggctcaaaatgggggcgagcatccattttgggacagaagcccatgccgcagtgaacgcggtaccggtagaaggatcaaaagcacaaattttttaggatagagaaaggtgacaacatgagaaaatatgtatataccggccttgccgcgatttttttggccggctgcagtgtaacaaacggaaaccagccggaaacgggcgcccataaaagtaccgcgccggcgaaaccggcccacacggataccgcgaaaaaaaccggttccggtttggtgcttgatgcaaaatattttaacaaaatcaaaacggttaacgggaaaaaagtgatccagaatccggacaatattttggcgcttgtcaataaaaactatattctcggggattacaaaccgaaagacctcgtccggccgaatgtccgcttttcatttggcgacgaaagaatcgaaaaaagctatatgcggaaagaagcagccgcggcgcttgaaaaaatgtttgccgccgccgagaaggacggcattgaattatatgccgcttccgcataccggtcgtataaccgccagaaagctgtgtatgcggcagaagtgcaaagttcgggggaagaacatgcagaacaggcggttgccatcccggggtcgagcgaacatcagaccggtctcgccgttgatattacaagccagaccgcccatttccttctctcacagcaaatggggaagcagaaggaaggcatctggcttgcaaaacatgcgcatgaatacgggtttattttaaggtatccgaaaaacaaagagaacattacgaaatatgagtacgagccctggcatttccggtatgtcggaaaagaggcggcagccgtcatttacaagcacggctggacgcttgaagagtatttcgaacatgtacataaggctgaataaatcctgggctcttttattaaaaagaaaaagctggtagaataaagaagttagaaatcgggagctatgacttttggaaaacggcatgaaagtggtgaagcctttggacgatgagaaaaaacagacggaatccggccaggaagaacaaaccggttatatccgtatgaaaaaatttaaatttgtcatgcttttgtttttcgtgattttcataacagccggcattacgaccgctgcctttgcgttcggcgaccaaaaagccgtcaacgtgacgactgtcaaccggccggagtttgacaaactatataaagcatatgacagcatccagaaaaaatattacacaaaagtaaaacagaagacgcttgtcgacggggccattaacggaatggtggaatcgctcaatgacccgtattctgattatatgtcaaaaaccgaagcatcagacttcaataacaccatttcttcttcttttgaaggaatcggtgcggaagtggaagaaaaagatggctatattgtgattgtttcgccgattaaaggttctccggccgaaaaagccggcctgaagccgaacgataaaatactcgcggttgacggcaaaagcgtccatggcatgagcgccaatgaagcggtcatgttgatcaggggcaaaaaagggacaaaggtgacactcacgatccagcatgtcggatcgaaagacgaaacgagagtgaccttgacacgcgacacgatcccggtcaatacggtttatgcgaagatgttgaaaaacggggttgcccatatccagattacgacattttcagacggcacatataaagaattcaaggcggccgttgagaacatgaaaaagcagggcatgaagtcgatgattgtcgatgtgcgtcaggacccgggcggactgcttgaccaggctattaaaattgcgaatatgtttgtgccggaagggcgtacgatcctgcagacggaagaccggaacggctcccgggagaaatatgtggcagaaagtggcacgaaaattacggtcccggcggttgtgatgatcgacggcggcagcgcgagcgcttctgaaattttggcggccgcactgaacgaatcggcaggcattccgcttgtcggcgaaaaatcatacggcaaaggcaccgtgcagtctgctgaaaaattcaacgacggatcgattttaaaattcaccgtccaaaaatggctgacaccaaatggcagctggatccataaaaaagggattgagccggatgagaaagtgtcgcttccggattatgccaaacttccggtgatcggaacagatgcagaattgaaactgtattcggtctcggaagatgtaaagacggcggaaaaaatgctaaaagcactcggttacaatccgggcagggttgacgggtacttcgactggaatacaaaaacggctgtcgaagctttccaaatgcatgaaaaaatgcagccgacaggcatcatcaatggcgatacggcaaccaaactgatgtctgaaatcagcaatcttattacgcggcatgatacgcagctcaaaaaagccgaagaagttgtccaaaaagaaaaatagcaaaataagccgggagatttgctcccggcttattttatgcaatcccatgcacgaaaaatgatataataaagtcaggagattcgctgtcccatatgagaaaggaaaggaatgggagtgttggagacaaaagatacagttgatctggaattcatcttccgtagaatataccgaaaaattaaagaagaactgcatagcttgttaaaagagcatgtgacgcttaacgaatttatggtgttaaaacttttatcggaatcctcgatgcgttcatccgatttgtcgaaaatactgcaagtttccgccagccatattacttctgtaaccgattcgctcgtggaaaaagggctgattgagcggagaagatccaataaagacaggcgcgtggtcgatttaattttaacggaaaaaggaaaatcgttaatcagtcagttgaaagaaaccaaatcccggtttctgaaagaccagttggacgtttttacggaggaagaacgggaaacattgtacaggctattccggaagtttgaagatcacctcaatcaaatgcactgatatgaaaacgcgcccatatacacaaaaagcgccctgaagccgcaagcccggcttcggggcgctttttttaaatgaatgtggcagcatgcaacatttaagaaaaaaatgtaacaatacccgtcctttttccgccttgtcaaccccgaaatccttccatcttttggatatttaaaaagacggtgccaatgtgtgaaatgataggaaattcgcacgatgcatgggaacctttgatacagctggctttttcattttcagtttgcaagcaggcccctgctttgctgcttgttctattttctcccagaaatattacaaaaatcgtatgttatgattctattgtgtacgagagagaaaccaacgaaaacgagggaggacatcattgatgaaaaaggccatgttcacaacagcagcagcacttgcactgatccttgcaccggcagtttccggcaaggcgggggcagcctcaaacgaaacaaactgcagcccgaaaacggttgttcaacatgaatacaagtttcatagcatgcaggaattggagaactggttaaagcagcagcataacatccgtttttcttttaaaccggcaaccaatcaaacggcttcaaacaacgcaggcaaaacgaaccagacaacggcagcaccaaagcaatcggcaccggaacaaacagcagcaccaaagcaatcggcattaaaacaaacttcaacgcaaccggcaggcggcacgcagtcacaggctgccaacacgttaaacgcctatgaaaaacaagtggtgacccttgtaaacgaagaacgggcgaaaaacggccttggcgcgctgaaaatcgatacggttttgagcaaaatggcgcgcgtcaaatcgaatgatatggcaacccatcaatattttgaccatacaagcccgacttacggctctccgttcgatatgatgaagcaattcgggatctcgtatcaatatgccggtgaaaacatcgcaatgggccagcaaacaccgcaggaagtcatgaatgcatggatgaacagcgaaggccacagagcgaatattttaaataaaaactttacccatatcggcgtgggctatgttgaaaacggccattactggacacaagaatttattggaaaataaattgcttatcgcagcctcttttacggggctgcttttttgtgcgcactttttgaaacgtcacttacggaaaacgggtccactttcctgtacgctggtccatctgccggataagccccgcttgtgccaaaccttatccattctttttcagcaaatctccggctttttgctggatataatgcaagcgtcctaaaagtgttaccgcacctacagcaaggcctgtgatcagtccgatccagtaggcaaacgggccgagggcggtgacggcatccagcaaatatccgagcggaagcccaataacccaatatgaaacaaacgtcataatggtcgtaatccggacatctttataccctcgaagcgcaccttgcaccggcgcctgaaccgcatctgaccattggaaaaagatggcatacagcaaaaaatgtccggttaaccggatgacagccggatcatcactgtaaaacgctgccacttgttcatggaataagtagagcaacagcccggtcaaggtggcgatcacaacagcggttataagtccgattgtgctgtacaggcgggcgtctttaaatcttccggcccctgcttcaaaactgacaagaatcgtcattgcaagcgaaatgctgagcggaagcatgtacaaaagcgattcaaaattcatggcggcctgatgggaagcgatcgtgtcagtgccaaatttgctcatgaacaatgtcacaaccgaaaaaatgctcgattcaaaaaaagtcgacaaccccatcgggatcccaagcgacaacagcgctttccagctgcggaaagaaaccgggtaaaacgtgcggagcagccgcatttcagcaaaacgcggcaaacgcataagcacaaggattgcaatcaacaagataagccagtaggtgatggcgctcgcaacgccggcacctgccccgccaagctgcggaaatccggcatgcccgaagatgaacagaacattcaatccaatattgatgggcagcgccaacagcgtgatcaacatcgatatttttgtcagcccggtcgcatcaatcagcgagcggcaaacctggtaacagaacaacggaatcagcccgaaggacagggcaaataaaaaccgatgcgcgaccctctccacatgcggtgctaaatccatccggccaaggaccggcccgatcgatagcccgcctgcaaacagcaccagtacagccatacagacggcgacgtaaaggctctggataaatgtacgggggatttcatccgtgtttttgctgccgatcaaatgggaaatgatcggggtaaccgcctgtaaaaccgttcccagcccggttgaaacggggaaccagagggatgcgccgatcgcaacaccggccagatcggctttggaaaaatggccggacatcgttgtatcgaaaaaattcatgagcagcatcgcaagctgggtgatgagaatcggcagaaataaatgccaaagctgtgcgattttttcttttaaggtaaaggtttgtttcatgttcattcccccaacttttccacggactccaaaaaattataacatattcatttttcgggccgccatggatagcctgccatgaagatggaaatgcccggcgaaagatttgcaaacccgtaaaaccatcatgatttataaaaagtctcatataatagagtgaccagacaaaaacgggagagtctgtatggagctgaaaaaaacctattcgacgttgtctcacatgtacctgtgtcaaaccgttattcttgcatgcggcctttccgcattttgtctcacgctgatgtatatcgggcgcggcggcatgttcaactggctgattttggccgtctggctgttcattctctactttgctgcgcgctatttctactatcaaaagatagaagaaaacatatccggagaaaaaggggaggaagaaagacaagcggacagcgggcagtacttgatccagtttccgcccggtgcaaaactctcggtgcagctttatgatggaagcggccgcttagggtggctgcttgaggaaaaagctttcagacaacaaatccggtatttccgccttgaacggggagcgggcgccacatttagcgccacggtccgcaaacggcaaaattgggaaatcagcatcgggtttccggcatatgaacggttcttttcattaaaaagagcaaagggaaaagaaatgatatttgaaaacggcagccggacttgtgcgatccggaaaaatggaaaccatgatttggaattttaccgggacgaacaacttttagcagtggtgtcacgcggcgtgatgccggtgagctggcagcagaagtttccgcttaatgcaccggtacttacttttatacgggggacggaagaagacgaagtactcgtcatcgcactgctcgcctttttttacaggcataataaatatttcgtgtaaaaaaaaagaagaaatgatacaatttttgtaagtataaagaaagaaaaagagaggaaatccatcatgcatgtgaaactgattaaatgccacggctcaggcaacgattttttgctgatcgatgaaacggaaatctctgcgccattaacggacgacatccgcaaaaaaatggctctgtcattttgccggcgcgatgccgggctcggggcggacggcctgctctttgtgtcggaaagccagcaggcagacgcaaaaatgcgggtattcaatgcggacggttccgaggcgtccatgtgcgggaacggcctgcgctgtgttgcgcggtacgtatccgaaaaacgcgggaaagacgatctgttaattgaaacgatgaaagcaaatctatatgcccgcaaagcagagcccctattggacggcatcccaacgttccgggtcgaaatctcgcctgtctcctttgacttgaacaaactgccgatgcatattgataaagaagtgctcatcaatgaaccggttaaggccttgtcggaagatttgtcgtttacagcagttgcggtgccgaatccgcatctgatcgcctttgtcgaaaatgaaggattccggtctgatacgcaaaaaacattgtccgagtatgtgaacggaccaaatgatatctttccggacggcgtgaatgtcagctttgccaaaccgattggtgaaaatggcttatacgtccgcacgtttgaacgcggcgtcggttttacaaatgcgtgcggaacggcgatgtccgcttcaagccttgtggcctgcctgttaagattgcgcccgttcggtgaaatgatcgacgtgttcaataatggcggtaaagtacggtgctttgtccaaaaaattgaaaaagaaggggaaccggcatacacgattgacctgatcggtaatgccacctatttatacgaaaccgctgtttcttttgacgatgggtacccggaacagttccggattgcagaaaaaaaggatttcggcgaacagaagctgtatcaaaagctcgaaacccatgcaaaagaaacggtagagaaagcattggcttaaaattttcgtctcctgtaaaagggaggcgtatttttttcgattggaaagctgcgccaaactatatggggcgccctttgttctgctttaaaaatgcaagtaccggggcaaaaggctggccgcttttgcaggcaaagaatcgcgcaaacgggcagccgtaccggttcacacgcgaaaggaccgtttcaatggtaaagtcatacggcgaaagcgacgcgtttacttcttcccagaaaagcggcgccgccacaagcgcatcctcatgcccgcgcatcgaataaggtgcaatgatcgtttttccttccgcatgctggacgaaatcaacatataattttccgccccgttttttcttcatccgttcgattgtaaaatgttcaggcgatttcgaaatgaaataagcagccataaattccgtgaacagccttgtatcttcccatgagaactgcctgtccggcaatggaatgtagacttgcagccctttatttccagaaattttgacaaagctctccaaatgaagggcatccgtcacctgttttaacagcaaagccgcttctactgcaagttgaaacgcatcccgggaaggggggtcaaaatcaaatacaatctcactgacgaaacggctgtttacggtctgaaacgggatatggtattccaccgctagctggtttgcgagccacatcagtgtttttaaatcgttgcagacaatataccggatgtcttcatgcatagccgtatccacaaaagcgggcgcataatcggggcagtttttctggtaaaatgcctcgccgaagacgccgtgcgggtaacggatgacggtcaaaagcctgtccgaaagaaacggcagcataaaaggagaaatttcccgcatataggcaagaaagtcgagctttgtcacatggcgctttttccatagcggtttatccggatgcgtcacttccacttcttccggaatggcggcgttacggagcctgaaatcttcaaacgtgcaggcatccggcgaaaggtcaaagcggaagcggtggaaatgcggttcccgcagattggcgccgtcccattccaaataaaatatctcgacgcaaatcgaaggatcgatcgtgtagacgccgttttcattgtttgtggcatttttcctgaccgcttctgtgaggatttgtttttcgtccggattcatgctgaaaagaaactggccgattggaaaaatgtcgccatctttaaacactgcgacatcgaaatacccgtttttctcgtcgtaagccgtaataaagcaggcggctgtcttccaatttttcacttttatccatgtttcaactcgttttcccgcttcccacttgctgtccgtttgttttgcgacaatgccttcactgttaaaatttttcaccgtctcttttaagacggatgcgtcacgggtgaacgggatttgctgaacccgtgccgtttcgcccggggcgggggagagcggcagcgcgagcgtttcacataagttttccaatgctttttttcgctgcaaatacggtttgccggccatatcctctccgccaagcatgagcaaatcaaatacgagataatgggcggggcgcattttcgcctgctctgcagctgcttcagctttcatccgcccgcggcgttgcagctccctaaagccagctttatacggattttcaagcagcacaagttcgccgtcaagccgtaacggaagctgcccttttacacggccttcaagcgtttgcaaaaaggtgcggatttccggaaaccggggcagcaaatcttttccgttgcggctccataaccgcatgccgtcttctgtccagtcgaggatcgcgcgataaccgtcatatttaatttcgtatacccactttcctgtatctggcagagaccattttaaaaccggcaacatcggtttcatttcgagcaccctttctttttccaaaagttgaagtacatagcggggtggattcgtacatatattatcttcaaaaagcgaggcgtttcattcatgcatacgatgtggaaaggcacgatcagtttcggactcgtcaatatcccgattaaactgcatgccgcaacggaagataaagatatcaaattgcgttcccttcataaaaaatgccattccccgatccggtatgaaaaggtttgtccggtgtgcgaggaagaattggacgcaaaagaaatcgtaaaaggatacgaaatcgcgaaaggaaagtttgtcgtactggaagaggaagaactggaagaactgcgcaaacagacagaagaaaaagcagtggaaattatggattttcttgatatgcgggagatcgacccggtctattttaaccggagttattacatgtccccgaatgaagggggcgtaaaagcttacggcttgttgcggaaagcgctgaccgaatcagagaaagtcggacttgcccggattgttatgcgttcaaaggagcagctcgccgttatccgcgtgtatgaaaacacgcttttgatggaaacgatccattacccggatgaagtccggaaagcatctgacgttccgaatgtgccgcaagatgatgaagtctcgaaaaaagaaattgagacggcaattttgctgattgatcagttaacgacatcgtttgagcctgaaaaatatacggatgcataccggtcaaacctgatggctttaattgaatcgaaacgaaccggaaaaaaactcgtcacggcaaaagtaaaagaaccggaaaacaatgtgaccgacctgatggcggcgctccaggcttccatcgacagggcaaagccggcaaaaaaaccggcaaaaaaaccaaaaaaagcggccaaaacaaaggcaaaagaagcgtaaaaaccgggcggtaccggatagcacggggaatgccggaaaatttgccggaaagcctccaatatggtaaattatttcatattggaggttgatgatgaaaaggcagacgattgtgcaatgggtgttcgttttactggtgctttccttctgcacctggattttttttgaaatcgccggtcacttcaaccaggcggagatccggcattttgaccttccgattatctcatttgtccaggggaatatttccggccggctaacgagcgtgatgctggctgttacctttctcggatctgtaaaaggggcggcggcggtcaccctctttctttcccttgtgctctggatcaaaaaataccgtacactaagcctttatctcgctgtatctgtcgcgcttggagccggggtttttaacaccatattaaaatacatattcaagcgccagcgtcccgatattatgcgtgtcgtccaggaaacgggttacagcttcccaagcgggcattcgatgggatccatgattttatacggctgcctcgtattgatcctgttccgcattgcgaaacgccggtgggtgaaggtcgcggggacgctgtttgcccttttattggtgcttgccatcggcattagccgcatctatttaggggtccactacccgagcgacgttgccggaggatatgcggccggccttgtttgggtcattttatctgcgcttgcgttgaacttgtttgaaagaaaattgaaattgtaataaaatatggtggaaataaaaatatttggcggtgggtatgcggaattccggcgcggacagccccgcttggccggaaagggctgcccaggggctggaaaagccgttgatgagcgcttgcttttttttaaaattgtattacaatatgttggtatgaataaatgaagcgtcctgaaattgttgccggagagtttggcaattgggagggaatactgaatgaagatctcgtttaaccagattaaaagtttgctaaataaaaaatacgccctgtactttctcatggttttattgttctgggtaaaaacttatattgtctataaagcggaattcaatctggatctgcaaaacggcatgcagaaatttttgcttgccatcaatcccatcagctcggcactgttcttctttgcgcttgcgcttttctttaagggacgcggccggatcattgcaatgactgtgattgacgtgcttttgtctgttttgctgtacgcgaatgtatgctattaccgtttcttcaatgacttcattacgctgccggttttgtcgcagacgaaaaacttcggcgacctcggcgggagtgcagctgcattaatgaagccttatgatattttttacttttttgatacgatcatcctcattgccttgattgcaacgaaaaccgtcagggccaacgcagggaaaatcaaccgccgctcgcttgccgggctgatgattgccgcgattgcatttttcatttttaatctcgggcttgccgaagcggaccgcccgcagcttttaacgcggacttttgaccgtagctatatcgtgaaatatctcggtatgtacaattacacgctttatgatgcgatccagacaacaaaatcgtctgcacagcgggcgatggctgacagcagtgacgtgagcgatgtggaaaactatgtgaaagcgaactataccgagccggacagcaaatatttcggcgcggcaaagggtatgaatgtcatttacgtttcacttgagtcgttccagaactttttgatcaattacaaattggacggcaaagaagtcacaccgtttttaaactcgctgacaaaggataaaaacaccttttatttcgataactttttccaccagacaggccaggggaaaacgtctgatgccgaatttatgatggaaaactcgctgttcccgctgccgacggggtctgtatttacgacgaaagcacaaaatacgtaccaggcagcacctgccattcttggccagaaaggctatacatcggctgttttccacggaaactataagactttctggaaccgtgacgaaatgtacaaatcgttcggctatgaccgtttctttgacgccaagtattacgatatgagcgacaaaaatacgttaaactacgggatgaaggacaaaccttggtttaatgaatcgatgcagtatttgaccaaattgccgcagcctttctatacgaagtttattacgctttcaaaccacttcccgtttccattggatgaagaggatgctgacttcccgaaaggcaatttcggtgataaaaccgttgataactatttccaaaccgcccattatctggatgaagcgatgcagcagttcttcacctatttgaaggaatccgggctttatgaccataccgtgattgtcatgtacggtgaccattacggcatttcggaaaatcacaatgcggcaatggcgaaagtgctcggtgtccctgaaattacgccatatttgaacgcgcagctgcaaagggtgccgctgtttatccatgttccgggcgtaaaaggcgggatcaagcatacgtacggcggtgaagtcgatgtaatgccgacggtgatgcatttgcttggcgttgatacaaaagactacatccagttcgggtctgatcttttgtccagccagcaccgccaagtcgttccgttccgtaacggcgattttgtcaccaataagttcacgcaagtatccggaacgctttacgacaatgcgaccggtgaaaaagtcaatccaaaacttggcaaaaatgatgaaaagattgcaaaagagatgctgaatctgtctgataaagtggtgtacgacgacctgctccgtttctacacaccaaaaggttttacgccggtgaaccggaacaagtacgattattcctttgaccagacggatatgagtgggttgcctgaaacctccattccggattcagccaaaaagaataaataaaacaaacaacccccggtgaatcaaccgggggttgtttgttgtgccgtgcaaaaagaatattgtgaatgcatcattccggatttcttatgggtttgcacaagtatgtccagctttccgttttcacactttattcaagcccttgtctattctcacgatgttgatggattaattgtaatacccacttttcgtcaaaacggagcttttctaaccggtgccggaaaaaggtcaggatatactgctgttcttccttgggaatccgtttatcccctcccgcataaaccaaccgttcttcctcatggcggatttcataacgcaagtaatctttatattgatgcaaaattaaaaactgcacttcctcactgaccagaccaaaatttttcagcttcatataaaaatgcagttcataatccggtgagtatggaatcggttcttccatcagccggaaaaaccggattctaccttcatctgtaagtttgtaaatctttttcttttttccttttccccgccgagcgccctccggttgttcttcggggacctgctcgatcagaccgtctgcaagcatgctgtgaatgagtggataaagcgccccccagctgatttttcgtgtggggcccacaattgcgttcaaaatttgatgcagcaaatagccgtgcatcgggttgttcatcaattcgccaagtatgaacaattcgttcaagcgaacgtctcctttccgtctaacttcctttttatggaacaagggatgctgaaccatgaatatccaacaaacagactctcgccatataattgtgggaagatggtgcagcgggaagcgccgggattccgcttaacctgtctggcggctgccaagttggcatggatgacatttgaaagccgcctcttttttaatgatcagatactaagtaaagggtattgccgtcagggtcattgaagtgtacgacctgggctgccttcccttcaacataatcatggaatttaacaccatgggatttcaatgtcttgatggctgcctctaaatcctgcaccacaaatccaatcgacatgctttctgattttgccgattgggcattccgctctccggtaagatgcaggagcccaatcgtcaatcccggtgcttcgatctgtacaaaatgatcgtccatttcgccctgcagcttcaatccaagggtttcggtgtaaaattgaacggctttttttaaatccgctaccgtaactgttacattcgcactcgtaaacatgatattgcctccttcataggtttggtcgcttttattatatcaaaaatttataatgtgtaaacatgtttttttgatataaaaaattggaagaaagaagatgaatggaaaatgcaagaagatagatttaacggcaatcagaaaatggtgcgtatttcaaaaagggattatcctagcaaagcaaacggagcagcatcatcatagttccgggcaactgttcattttctgctccccgtatgtaataaaaaaaggaaggcatccaccttccatgcataaatcattttttaaagagcaaatccatggcagtttgaaaatcatttgtcggttgattgcagctgaagttttcacagacataaatggttggttgtccgtttatcatggcataatcttcaataaaggaagcgattttggagagtttcgcctgttcacgcctttttaccaccatgacggaaatgccagggtagaagttcttctgtatatggttaatgaaatcaacaacttcttttgtttcatcatccatcacgatcacgacttcttttgttgcctgctgtgcgtacatcacagcctgcagcatcatggcgtgggcagtgggttcatcatcgatatccttgctgaaggcctgaaacaattgctggactttttcttccaacgtaaaatccccagtcagtttcgaaagccttaacaactggcaggctgcaacactgttcccggaaggtagtgccccgtcataagactccttttgcctgacgagcaatggttcatcgtcgtttccgctaaagaaaaagcctcctccatgaccatcccaaaataaatcgatcatattgccggccagtttttttgcttccgccaaataaaaaggggcaaaagtggattcgtacagttccatatatccccacaggagaaaggcatattcgtctataaaacctttattttttacttcgccatcgcggtatctcaccattacacggtcattttgaatcaagttgtccctgataaaagaaaccgctttttctgcagcctgcacataggatggttgatgaaaaacacgccctgcttttgcgagcgctgcaatcattaagccgttccatgccgttaaaattttatcatcgcggaacgggcgtacccgcttttcccggtgttgaaacaagctttgccgtgccgtttctaatttttctgcgagcgccgcgggagaaatcccttctttttttgcaattgattctaaatgcgttgtaatctggttcgggatattttttccttcgaaatttccctgcccggtaatgccgtatgcctggcaaaagagcgtgcccaactgttcccccagcacatcttttacttctgcaggcgtccacacataaaactttccttccttaccttctgagtcggcatcttccgcggaatagaacccgccatccggatgggccatatcacgcagcacatacgtgatgatttcttccgttatttttttgtactgggcatttttcgtcatccggaaagcatcggtataggccagcacaagcagcgcattgtcataaagcattttttcaaaatgtggcaccaaaaatttttcatcaacggaatagcgggaaaaaccgtaaccaatatggtcataaattcccccgcgcgccagcccgtccaatgttttggttgccatcctaagcgcatcccggttttcataaaatttggcatacatcagtaaaaatacgagtgaatgcggcattggaaatttcggcgcctttccaaaaccgccgtagcggggatcaaaaccttgtttgtaagcttgaaaagcgcgcccaatcgtttcttttgttaaagccgtttgtttccctttttcccggcttgcctcgagcgcctgtttgacttgtacccctacatccttgatacagtccggattttcggtatattgttgggataaataaagcaacacttctttaaaaccgggcatcccataccggctttcccgcggaaaataggttcccgcataaaaaggaaccctctccggcgtcaaaaatacactcaacggccagccgccctgcccagtcatcatttggcaaacaagcatatagatagcatcaatatccggccgctcttccctgtccaccttaatcgccacaaatttctcattcaggatccgcgctacctcttcattttcaaaagactcccgttccatcacatggcaccagtggcaggttgaatagccaatggaaacaaaaaccggcttgttttcccgcttcgctttcgcaaaagcgtcttcgctccacggataccagtcaaccggattacgggcgtgttgcagcaaataaggcgatttttcatggattaaccgattgaatggtctgttttcagccaaagcattccctccttctttctttcagtttcttcgtcatcagtttacctgaaacggtaaggcgctacaaatgatatcgcacagcgccaaaatttaggcaggggaagaagcttcagcgcgtgatttgtccggtttcaccgccacaaatgtaagtcctgccgccaccaggcagaaaccggccatgatcaccatgctgatctcaacccgccctttcataaaattggccataaataacggacctgccgccacgccgatgtagcgcatagaactgtaaatggcgctgatcgttccgcggacttctttttcaatcgactgattaatcagcgcatccaaaggcgtaagggaggcgccgattccaattccgcaaatgagaaaggtccctattaaatagaaaaaacggtccgaaaaagtgatcacgagcacggaggctccggtaatgagcacgctggagaaaataatccatttcatcagtaccatgttttctttaatgattttcccggttataaaggaagaaaggcacaatgccgcaagcgggacggccaaaataaaccctttcttcacgccatggtagccgtattggtcttccagattggacgacaaataaaacagcaccgcaaacaaaataaacatcacgatggccccgatcgcaaatacggccgacagccagcgccagtgctttcggaacacctttttcgtattccctataaatgctttgattcccggcccctgtttttcgtgtgccggccttttgacaagaaacaaaacagacaggatagagatcaggcaaaagacagggatggccgcaaaaggcaaaaaccagatcaatcctgccaagaaggatccgagaatcgggctcaatacttttccaaacgtattggccgtttcaataatgccgagggtggtgctcacatcccggttgcggtgtaacatatcaccgacaagcggcaaaacgatcggtgctgcgccggccgtcccaacgccctgcaaagtccggccgatcaaaataagggaatacgggtgatcaagttgccaggccgcgtatgccgaaatcgcccctcctatagccgtaatcgcaagtgacgggataatgaccatttttcggccgtatctgtccgataaaaatccggcaaccggaataaggaaaatggcgacaattgaataaaaggtgataatatagctggattggactttgctgatgcccagtttgtcctccatgaggggaaggaccggaatcaacattgaattccccagtgtcataatcaggggaatggacgataatgcaacaatcgcccatcttttttgatggatttcattgtttttatcggataaaggtgtgttcgttgtcaaatgatccattgtctgtattttcctttcttcttctcaatgtcagcactcttctttactactatctgcccaaccggagacatttatgaatggaaaaaacgggttttctttctcatcattttttaacaaaccattcatatctttttcctttcattcggttagcatataagaaaaagcggattctccttgatcatgcgctgtccggagctataataagggcagcggaaaagaaagagttccggcaaaagaacttcgagggggaatcatcatgaaacggatattactggtggaagatgaaaaaaatctggcccgttttattgagctggagttaaggcatgaaggatacgaagtgaaagtggcgtatgacggacgggaagggttgcagtcggctttggaggaggattgggatgtgattctccttgatttaatgctgccgaaactgaacggccttgaagtatgccgccgcttacgacaggaaaaagaaacaccggtcatcatgattaccgcccgggacagcattatggaccgggtatccgggcttgaccacggggcggatgattatattgtcaaaccatttgcgattgaagaattgctcgcaaggctaagggccattttcagaaggatggagtacgccgagcccaaaaaagcagcgctaacaacgtacaagttccgtgaccttgtgctggaaaaagaaagccggcttgttaaaaaggcaggaaaaaccattgagttgacaaaacgggaatacgatttgttgcttacgcttttggaaaataaaaatattgtcatgacccgggaagcactcctgaacaaagtatggggatatgaaaccgaggtcgaaacgaatgttgtcgatgtgtacatccggtacttgcgcaataaaattgatacagaaggcgaagacagctatattcagacagtgcgggggacaggatatgtgatgcgcgaatgagagcggtaaaacactggctgcaaaaaagttccttgaaagtaaaatggtccgttggcgcaagtattgcgatctttttaacgtttctgattttcggctttttccagtatacgctgatcagcagatggcttttgcatgaagaggcgacttcggtatccgaggcgctggatgatttgaacaacaagggggaaaacatcgatgacattttatcgaaccggacgctctttcagcaggtgctggaaaaagatcagtcgatccggattatcaatgcggacggaaaggaaatgcttgtcgtaaaaagcattcattccaccgatgcaaaagtgccgtttgtgccggtgaacgaaaaacgggtcagcctgatccgcgcgggcaatcatcaaattttagtcggaaggagcccgttccgctcccaatcgttcaacggctatattgaagtgatctatcctttataccggtatgaaaatttaatgcggaatgttctgtttgtcatgatggtcgccggatgcgtgggcttgcttttgagtgcttttctcgggtttatgatggcaaaaaatttcctcaaaccgctgaaaaagctctcttccacgatgcaaagcatccgcaaaaaaggattccaagaacggatggagccgagcgcctctaaagacgaaatgggggaattgaccaatatttttaacgatatgatggaccaaattgaacagtcgttccggcagcagaaacggtttgtcgaggatgcttcccatgaattaaggacccccgtccaagtgatggaagggcacttaaatttgttaaaccggtgggggaaaaatgaccctgcgattcttgaagagtcgctccaggcttcgctgcaggaattaagcagaatgaaaaaactggtggaggaactgctcgatctttcgcgggcggaagaagccaaaatactggccaatgaggaaaaagcagatcttttggcagtcacagaaagggtgatccgcaattttaaaatgatccatcagcagttcgacttcaattttcaatatgatcccaatcaggcctatgacatccaaatgagcgagaaccatcttgagcaggtgctgatcattgtatttgataatgcgataaaatattccgaccgcatttacaaagtcgatatccgactcaagcaggaaaaggggagggccatgttaacagtaaaagattacggcatcgggatcccgaaagaagatttgccgcaaattttccaccgcttttaccgggtggataaagcaaggagccgcgcaaaaggcgggaacggactcgggctcgccattgccaaacaactgactgaaggatattccggcacgatagaagcagcgagcgaggttggtaaagggaccgagatccggtttacattcccccttgtcgcaaaacaaaaaacaggtggaaaagagggcgtttcgaaaaaatgaaacgttcttttttctttttaaagaaaaggtgcagggccgtgtctggcaaggtgtccgcctttcgcccgtgatgggtaagtcttttgatacgcaaaaaaacgggaactgtcagaaccaactgtaagttttatcgagaaggcagagtcgttaaaaatcaatgccgacttctgtcatttcatgttcgctttttttcaggagccggatttccaggatgccatcccggtattttgcggtcgtccctttcctgcgtaccggggaaggcagccgtatcacctgttccgagtccggttttggaaatgattttaacatgacttgaagggaagtgtggaagatttttaagcctgtgagcatgctttcctcctggacagggacgcggataaaaataaaatccagtgtttcaaatatttttatagacggggcgcccgtatccggggaagagggagccggatcatcggccccgtcccccttcttgaacgcagcgccccattcgtcccattgagaaagggcttggttgatatgttcctgtacaggcggaaatggcatattcatcatcttgaagatctcttcggtgaacggaaacgttttccatgggaacatttttttgctcctttctgcaacggggatataataaaatatgcggttttgaacaatcaggtgaggcaaatgcagcatcactttccgggaaaaaacagaatgaatcactattcatgcaaatttttaaaaataagagtttttaactttatctattacgcttacagtgctaaaattgagtttgtaagcgttacagctttcaaaattctttatcgttacataatttcatggttccgttttggtatccgccagacgaaatcatacgaaagtgaataagggacgaagggctggaggtttttcaaaatgaatgcaactacaccaaagggattttgggaaagtttttccgggcctaatcttgggtatgtcatggatttatatgaacaatacctggaagatccggagagcatcgacgaagaggcgagaaaagtatttgaccagtggggcgcgcccgctgtttccgaaggcgggagcccgacacaggggcaggcggatatttctttccaattgccggcaaacccgacgattttcagcaaaatggtcgctgccgtcaaattggcggacaatatccggacttttggccatctcgcagcggatatcaacccgctccaaaaacctgttggggatgtcagaagaattgaactgggagaatttgatttaaccgaagaagatttgaaaaaagtgccggcatcctttatttgcccggatgcacctaaaagggtcaaaaacgggcttgatgccatcaattatttaaaagaagtgtacacccaaaaagttgcctttgagtttgaccatattcacgacatggaagaaaagcactggctgcaacggactgttgaatcgggcagctttttccgcgaactcagccggaaacagaaaatcggcattttaaaacgcctttccgatgtggaaggatttgaaaaatttatccaccggacatttgtcgggcaaaagcgtttttccattgaagggcttgatgcgctcgttccgctgatggaacaaatgattattgaagcggtaaaaacaggtgtgaaaaccgttaatatcggcatggcgcacagaggccgcctcaatgtgcttgcccatattcttgaaaaaccgtatgagctcatttttgcagaattcaagcatgcttccaataaagatttaatcccttccgaaggatcgatcggcattacgtacggatggaccggcgacgttaaataccatctcggcgcggacagaaaagggcaaaacggcggaccgatcggcgcgcgcatcgtacttgccaacaatccaagccatttggaagttgccgatcctgttgtcgaagggtatacacgcgccgcgcaggataaccggaacaaaacgggctatccggaccgcgatccggaccgcgcctttgcgattcttgtccacggggatgccgcatttgcggggcagggcattgtcgcagaaacgctgaacatgagcaagctgaacggatacgggacaggcgggacgatccatatcatcgccaataacaatatcgggtttacgaccgaaacgtatgactcgcggtcaacgaaatatgcttccgatccggcaaaaggttatgaagtgccgatcctccatgtgaatgcggatgatccggaagcatgcgtacaggcggcgctgtttgcgtatgcttaccgcgaaaaattccataaagattttgtgatcgacctagtcggctaccgtcgctatggtcataacgaaatggatgaaccgatggtaaccaacccggtaatgtaccatgcagtgcacaatcatccgacggtcagggccatttacggtgaacagcttgcaaaagaaggcgtcctgacagccgaagaggtcaaaaccatcgatgaagccgtccagaaaaaactgcaggcggcttacgaaaaagtgccggacggcgaagcggaacccgatacggccatggaaccccctgaaaatgtgaaaaaaggttatttgagcatggaaacaggggtgccggaacaggaactgcgggcttggaacgctgaattgctcgcctggcctgaaaacttccatgtctttaaaaaactggcgcggattttgaaacgccgcgaacacgtctttgacggcaagggaaaaattgactgggcccatgcggaagcgctcgcgtttgcagccattttaaaagatggcgtgccgatccggtttaccggccaggatacacagcgcggcacgttcgctcagcgcaatctcgtcctgcacgacgaacagacgggggaagaatacattccgcaccatcatctgtccggcgttcaaacttcatttgccatttataacagtccgctgactgaagctggcgtcgttggctttgaatacggctataacgtcttttcgccagatacgctcgtcatttgggaagcccagttcggcgattttgcaaacatggcgcaagtgatgtttgaccagttcatttcatctggcagggcaaaatgggggcaaaaatcagggcttgtcatgatgctgccgcacggatacgaaggacagggtccggaacattcaagcggcagggtggaacgcttcctgcaactggcagcggaaaacaactggacagtggcaaatgtttcgacagccggccaatacttccatattttaagaaggcaggcaaaatggctggcaaaagaagaaatccgcccgctcgttctcatgacgccaaaaagcctgcttcgccacccgctggcatctgtagagccgtctgtactgacggacggaaaattccacactgtgctggaaggcccgggtacgaaaaatacggatgcagtcgaaagaatcctgctttgcagcgggaaagtggctgtagacttggaagaaaagctgaacagtgcggaaaataccagctggctgcatacggtaagggttgagcaaatttatcctttccctgaacaggaattaaaggaaatcttcgcgcgctttaaaaacgcaaaagaaattgtatggatgcaagaggagccgaaaaatatgggttcctggtctttcgttgaaccgtatttaagaaagctggcgcctcagggagcggaaatccggtacatcggccggccgagaagatcaagcccgtcggaaggcgacccggtcgtccataaaaaggaacaaaacagaattctgactgaagccattacccgcccttaaacggcggcccgctccttccaaaggggcgggggcttcaatatgcgcaaaataaccgctgctttgcccgcttcatcctgcagcccgtgctgctcggaagatgaaggaggaggctttgatataaaaaaagtgatacttttaagggaggacaagtgttgtggctgaaattaaagtgcctgaactggcagaatccatcacggaaggaaccattgcacaatggttgaaacatccgggggaccatgtggacaaaggtgaatatattgtagaacttgagacagataaagtaaatgtagaagtcatttcagaagaagagggtgtcgtccagtccctcctttttgaagaaggggacacagtacaagttggcgatgtcattgcaattgtcggcgaaggaacaggggaaaacagtgcaacgccatccgcgccgcaaaaagaagcggaagcaccacaaccggcacaagcagaggcgccggcgcaaacacaagcgcctgctccggaacaacaaaagccggctcaggaagaaagcgaaagccgcccgattgcttctccggctgcccgcaaactggcacgcgaaaaaggcattgacttatcgcaagtgccggcagtggatccgcttggcagggtaaggaaacaagatgtggaaactttcaatccgcaagctgcggcaaaagcgccggcagcaccggaaaaacctgcagctggaaaagttgtgccggaagaagccggcaaaccgattgaaagaatccgcatgtcacgccgccgccagacgatcgcaaaacggctcgttgaagtgacacagacaacggcgatgctgacgacattcaacgaaattgatatgacagctgtcatggatttaagaaagcggaaaaaagaacagttcgttaaagatcatgacatccgtctcggttttatgtcgttctttacaaaagccgtggttgcgggattgaagaaatatccgtatgttaatgcggagattcagggcaatgagctgctgctgaaaaaatattatgatatcggcattgcagtatccacagaagaagggcttgtcgtaccggttgtccgggattgcgaccggaaatcgttcgcggaaattgaagcggatattgctgcatttgcccaaaaagcacgcgataataaacttgcattaagcgatctgcaggggggaacctttacgattacaaacggcggtgtcttcggctcgttgttctcgacaccgattatcaacgggacacaggttggtatcctcggcatgcacaccatacaaaaacgcccggttgcagtcgatggagaccgaattgagatccgcccgatgatgtacgtggcgctttcctatgaccaccgcgtcattgacggaaaggatgctgtcggtttcttgaaaacggtgaagacattaattgaaaaccctgaagatttgctgctggaatcttaatagtatgaaagaaaagcatcggttttgccgatgcttttctttttggtgccctttaagggttggcaatccagacgcttttgacttccgtatagttttggagtgcgtaagaacccatttcacgtccaatgccggattgtttataaccgccaaacggggaagcggcatcaaaaacattgtagcagttgacccaaactgtgcccgcacggagacggtttgcaatatagtgcgcattggccacattttccgtccaaacccctgccgcaagcccgtactcgctgctgttggcgcggctgattacttcatcaagggattcatatggcatggccgcaataacaggaccgaaaatttcctctttggcgatcgtcatctcatcacggacatctgcaaaaatcgtcggttcaacaaagaagccttcttcacgcggttttttcccgcctgttacaatttccgctccttcatcgagtcctttttcaatgtaattcaaaacgcgcgcttgctgctcatctgaaacaagcggccccatttccgtatctttattgagcccgaagccctgcttaatcgactgggcgtgggaggccatatcggcaatgacattatcaaaatgtttcttttgaatgaacacgcgcgaaccggcacagcatacttgcccctggttgaacatgacaccgtttaaggcgccaggaatcgctttcgacaagtcggcatctggcaaaataatattcggggattttccgccaagttcgagcgtcacccgttttaacgttttcgaggcattggccataatcagttttccgacttcagtagaaccggtaaaggcaattttatctacaagcgggtggtcgacaagggcggctccggcagtttccccaaagcctggcacaatattgacaacgccgtccgggaagccagcctcgcttaccagctgcgccaagtaaagggcggaaagcggcgtttgttcagccggttttaagataatcgtgcagccggtcgcaagcgcggcacccattttccacattgccattaaaagagggaagttccaagggataatttgcccgacaaccccgaccggttcatggcgggtatagttaaagtaagggccgtttacgggaatggtctggccggtgattttcgttgtccagccggcataataccgcatatgttcgatggcaagcggaatatcggcatttgccgtttcacggatcggtttcccgttgtcgagcgtttcgagctgcgccagcgcttcccggtgctcttccatcagatccgccaatttatacattaaccggcttctatcggcagggttcatccgcggccacgggccttcgtcaaatgcttttctggctgcttgtacggcacggtcgatatcttgtttatccccttcatagatcgtagccagcgtttcgccggtagccggattcggcgtatcaaatgtttttccggatgcactttcaacaaattgcccgttgatgaacattttctttttgccctgaaggaaatgctgaaccctttcatccaactgcacggttaattgttccattccaacccctccatttatgttaatttcaaggagacaagcctccttatatacttgctttgtgcaccagcctgtcagcgcttacatccatattctactaaatatcaaaaatagacgcaatagaaatcattcgaataatttgaacataatctgcggaaaatcgcaaaaattcgacatacccctttatgaataattattcgctactaattttctaataaaaaataattattttatctttttattttactagtttcatattataatctatatatacatatattttaagaaacgagggataaaattgacaatgaatgagagaatggcactaaaaatccgcctggagcagctggaagacgctgagattcgggttatacaggaattccaaaaagaacgggaaaatatttttaaaagattaagggagctggatgaaaatgaaggccagcaggtaaaagcatccggcaaaccggaatatgtatcttttaatgcgcttgcgtccgtctcgccggaaacctcaggcggcgaagcccttacgaatgaaagaaaggtgcggaaatcgcggtcgtcaaaaaagggcaggtcgggcaagatgagagaagaggctatccaaatactaaaaaacgtttcggaaccgatcagaggggctgaactgcagcggatgatcgaagaaaaaaccggctataaaatcgctaatatgacctctttcatgaaatccgtcgaaaaactcgatccgcgtatccgcaaaccggaccgtgggttgtacgaatttgtgaatgatacagcaaatacggaagaaccgcatcaggaaatggagcaaaatgagaacttgccggaggaaaacgaggcagttactgaacagaagtaaaccggtataaaaaatccccggaaacccggggctgtaaacaacataaaagcggcgggaacacatcaactgtgacccgccgcttttttatattttgatgatcagatacaattatgaattggattcttccttcggcggatgggactgataaaattttttctgaatcagtgtttgtccgatcataaagagcccgctcactgtccagtacagcggcagaaccgccggagctgaaaaagaaacaaaaaggatcatgatcggcgacatgagcatcatatatttcatttgtttcttctgttcctcaggaataccgatcagtgaaatttgggcttggataaaataaatgacaccagcgagaatggccatcggaatatctgtttgtccgagattaaaccataaaaaggagtgggtggcgatttctttcgagccgcggatcgcataataaaaccccattaaaatcggcatttggatgataatcggcaggcagcccatattcagcgggttaacgccgtgtttttgatacaaccccatcatttcctgctgcagctttgcctgttcttctttcgttttggccgctttgatttttgtctgcagcttatccatttccggcttcaaaactttcattttatcctgcatgatttgctgttttttgaatgtatgcagcataaaaggcatgagaatcagccggatgattaacgtcaaaacaataatggcaatcccgtaatcaccatgaagcagctgggccgttgctttaatgacaactgaaaacggggcaacaaaataatgatggaaaaatcctccgctgtgcgtgctgtttgttgaatttgaacatgcgcttaaaacgaacagcaaactgcttaaaaccaatgtaaaactgaaaaatcttttcatgaaatatcctcctttagtatattgcacaaatcctgtcctttctgaccggtcttaaatccggttccgaatcaggatcttcagaaggatatgtccgtattctgacgcaacttaaaatccaaatcgtaaagaaattgcaccggcattccgcagccgggcgggtgtgtacagtaaaatcctgcatgacggcggcaggccttgcttcaacaaacgctgccggcctgatcacaaaccgactcaaataaagaaaacctgctgccagtacgtaaaatgacagcgtgcagacggccgggtcatttacaaaatcgatgatgttttgaatcaaagctattcactcactttaaagagatcagtacaaagtatactttaattttgtctgttttacaatcgtaatcatcattttaccatacactgcgaaagaatcctaatttaagggagggggagtatgcccgggcagcatgaaaatggaaaaatttttacgcgcatataaaacggggctgcccggatggacagtcctcagttacgctgttagtgaatgtctttcttcttaaatctgccgccgcgcacttctgatatgtttccaaccgcgataaaggcgctttcgtcaaattcttctacaatcgatttcaattttgcttcctcaaggcgggtgatgacgcagaaaatgacttttttattgtctccggtataagcgccttccccgtttagataggttaccccgcggccgaggcgggccatgatcgcatcaccgatgtcatacatctcgtcgctgatgatccataccgatttggattcatccagcccctgtacaaccacgtcgattgcttttgtggcgataaaataggtaatgaccgaatacatagcatatttccagctgaacacaaagccggcacaggtaaaaatgaagagattgaggccgagtatgatttcaccgacagagaaaggaagctttttgtttaatagaatggcaagcgcttctgttccgtcaaggcagccaccccagcggatgacaaggccgacgccgatgccaaggataataccgccaaaaaccgtacacagcagcaaatcatccgtaaacacttttacaggggtcagcaggatggttgtcaccgacatgatggagatgccgtaaagggtggtcaaggcaaaagttttcccgatttgcttgtacccgatataaaagaatgggagatttaagatgaaaataactggccccagtttccagccggcaaggtgggaaaggataatcgagatgccggtgatgccgccgtccagaatctggttcgggacaaggaacagctcgagggcaacccccataatcatcgcgccgaggctgacaaagataaaacgctggccaagtaccgcccacttatttttcttctgcctgaattgggcatatgtttttgccgtttcttccatattttatcccctttccaaatgtttttgtgaaaaaatgtacattttacgcatacataagccgttcctttaagagcggcgttttccaaagccaaggatttttccctgaaccggagaacgaaaaaatatttacaatgaaggacgctcccgatcaaacagatgagaaaaagcgggcttttaacacagaggagaaaatcggtataaatatctataatataattatattataagaaagttaaaaagtgaatgaatatgcatttccatgttgtttaaatttttcccggccgttttgaatcatggggaagggcgcgcttttaggggcccaaattgcccgtattgaccgcggaaatgtttataaaaaaagcccggctcggccgggcttttcaaatatccaatctattctttttccaaggcggcttttaaagcatctgccaggctgttgccgaaactttcctctttctttgtgtatttttgcagcaatttcttttcttcatgttttgacaaagtttttttcttttcgtctgctttttggacaatattgcagtggcggcactggaaatagacgccggatttgccgtgatggatctccatctttttatggcaggtcgggcagcgcctatttgatagtttcgggcttttccgctttgtaaaccggcattcccggtttgaacagacaagctttttcccgtctttgccgtttacttctttcataagggaaccgcattccgggcattttgttcccgttaaattgtgggcgcggtattttttgtcactcgtccggatttcacggacgaggcgtacggtttcccggcggatggtttccaaaaactgcttcgggttgccttttccgcgggcaattgcttcaagctgttcttcccatttggcggtgagttccggcgattttagctcgtcattgacaaggtcgatcagctgcttgcctttcggggtcggcacaaggcggccggactcacggctgatcgtttcggaggagacgagccgttcaatgatatcggcgcgtgttgccggcgtcccgagtccgtatttttccattctcgaaagaatatccgcttcggaataccgtttcggtgcttcggttaaatgctggctgagccggatttgttccagcttaaatttttttccttctttgatcgaaagcagcgccgtattttcccgctcctgttcatggtgcaaaacagcggtaaaaccggcatttttcacggccattgtccgcccggtcatggtttttccgcctgcttgaagtttaaattggacggtttcatattcataaaccggatagaatagcgcaaggaaccgttttacaatcagatcatagattttccgttcatcggcagacaaatctgataaggccgggcgttcatctgttggaataatcgcatggtggtccgtcaccttcgcatcattgatgacacgtttggccagtattttacctttccgggaaaggatcggctgaacttcttctttgtacgcatctttcaccgcaagcagccggtcgtacatcgtattttccatatctttcgtcaaatatttcgaatcggtgcgcgggtaggtaacgagtttatgctgttcatataagttttgcagcacgttcaatgttttctttgctgtaaaaccaaaacggtggttggcgtcgcgttgcagttccgtcaaatcgtaagggagcggctgctgctcttgcttctgtttgcggatcacttctgtcacgacggcagtctgcccggataaagccgcatgtatggcatttgctttttgctcgtcaaatatccgtttttcgccatgatggtcatacgatacttcgagttttccggcgagcgcttcaatggtccagtattttttcggcacaaaagactggatttcccgttcgcgctcgagcaccatcgccaatgtcggtgtctgcacgcgcccggcggagagcggatcgttgtatttcacggttaaagcacgggatacgttcaatccgatcagccagtctgcttcgctgcggcaaacggcggagtggtacagattgtcatactgctttgccggttttaactgcttgaatccgtctttaatcgctttatcggtctgggaagaaatccataaccgtttcaccggttttctccagtgcattttttccagaatccagcgtgcgacaagttcgccttcgcgcccggcatcggttgcgataatgcagtctttgatgtcgcttcttttgccaagctgttcgatcgctttatattgcggataggtctgccggattgttttaatttccattttatccggaagaatcggcaggtcttccatacgccattctttatatttcggatgataatcttccggcattttcagttcgatcaaatggccgagcgcccatgtcacgatatagcgcggcccttcaatataacgttttttattttccgtgcagccgaggacgcgcgcaagttcgcgcccgacgctcggcttttcggcgagtacaagcgatttcattgcataacacctttcttttattcctgtctgaacaagtataacgcatcaaacaggattgataaatcatttcgtttcttctgttttcacagtgaaaattttgaaatgcaaacgggcttttggtaaaatggtggtttgtaagagacagtgtaacctgaaagcctgcattatatcttgcaaatataattggataggtggttatcaataatggaacaaacaaagccgtacagagtcttattgtattacaagtatgttgaaattgaaaatccggaagcctttgcagccgaacatttgcagttttgcaaagagaccggtttaaaggggcgtatcctcgttgccaaagaagggatcaacggcaccgtttccggaacggttgaacaaacaaccaaatataaagaaaagatgcacgccgatccccggttccgggacatggtctttaaagaagatgaagcagatggccatgcgtttaaaaaaatgcacgtccgcccgcgtaaggaactggttacgctgcggcttgaaaaagatatcaatccgaatgaaaaaacgggaaaatatttatccccgaaagaatttcgcgaggcgctgctggctgaagataccgttgtactggatgcgcgcaatgattatgagtatgatctcggccatttccgcggagcattgcgcccggatatccgcgctttccgcgaactgccgggatgggtgcgcgaacataaagatcaattaaaaggcaaaagaattgtgacgtattgcacaggcggcatccgctgtgaaaaattttcgggctggcttttggaagaagggtttgaagatgtcggccaactgcacggcgggattgtaacatacggaaaggatccggaagtgcagggcgagctgtgggacggcaaactgtatgtattcgacgaacggatttccgttccggtcaatcgaaaagaacatgtcgttgtcggccgggattattttacgggggaaccgtgcgaacgttatgtcaactgcgccaacccggcctgcaacaagcaaattttatgctcggaagaaaatgaacataaatatatgcggagctgctcgcatgaatgccgtaccgtaccaaataacttatatgtaaaagaacacggccttacaccggaagaagtggctgaacggctgcgccggatcgaagaagaagacgcggcgttaaaccggtaaccggtgcggcttttaaccttacgatccgaaaagcggatggtgaaaaagggcatggaaaccgtgctcgctccctgccggaacgattccttgcttcggaaacggcattttcttgaaagaaacaaggcctaaagagcggaatgtgaaaaagagaagaaaaaccgggaactgctgcaaacatcccagctcgggggcagggttaacaagcggtgcgttccggaacagagaaaggatttggtgcaactgggccaaatcctttttatctgcctgttttttgtgtaaaatggggaaaaatgggcatctttgccgcttcatacgcggtatggcagaggatgaaaatcagcgggcaatattttcaggatagaaagaaaggcgggatttggatgtgcgggaggtacacgttaacggcatctgtaaatgaattggaaaaaaggttccatgccaaagcttctttttcaagcagtgaatatgccaaaagttataatgtcgcgccttcgcaaatggtggctgccgtgatcagcgcccatgggcagtacagactcggttttttaaaatggggcttgattccttcctgggcaaaagatccgaaaatcgggcataagatgatcaatgccagaagcgaaaccgtatttcagaaaccgggtttccgggaggcagtgaaaaggcggcgctgcctcattccggccgattctttttttgagtggaaccgaaaagacggcacccgggcgccgatgcggatcagtcttaagaacaggggcatttttgcgatggccgggctttgggaaaaatggatggaccaggaagggaatccggtctttacttgcacgattttaacgacaaaggcgaacaggatgatggcaaaaattcacgaccggatgccggtgattttacgcagggaagatgaagaaaaatggctggacacatcggtcactgaggcgggccggctgttgccactcctttcgcagtatgatgcagacctaatggaaatgtatgccgtatctgaacgcgtcaattcgccgaaaaacaattttccggagctgttattgccaaaagattaaattttttgttgaaatgttgtggcaaaaagtttatcataaaggtgacaatttcatgaacgtaaccacagggggagcgttaagctgagagtgaacgccatgttctgaccctttgaacctgtccggttaatgccggcgtagggatgtggaatttcttttgtcctcccatggttcgttatgttcatgcataccaaaagggggatttttttatgggcaaattaagtttacaggctatgattgaagcggctatttttgcggcgttcgcgctcgtgttggacttattgccgtccattaaggtgacgtccgcgatttctctgtcgtttgccatgctgccgatttttgtggtcgcttttcgctggggatttaaagcaagtgttgcttccggatttatttggagcctgctgcagatcgtcaccggtgatgctaatgatattcttaacccgcttcagggcatcatggaatatccggtcgctttttcgttcatcgggtttgccgggcttttccggccgcttgtcgaaagaagctgtcgtcactataaaaagggcacgatgactttttggatatgcctttccgttcttaccggaagttttgcccgctatttctggcatttcgtagccggcgtgattttttggggttcctatgcgcctaaaggacagtcggcgtttctctattctctcatcatgaatggcggcacgatgattgggaatgcgattttatgcgcagctgttgcggcgattctcttgaatgccgccccgcagctgctgacaaaataccgcaatccgcacaggcatgcggcataaaagcaacttgaaaacggcaaggccaactgcgccttgccgttttcgctgaaggaaagaggcttcatggtaacaggcgccttgtaaagccggcagtccggtttttactgctttttcggttgatgataggaggctacgggtaatgctttcgagaaacgggaaaagataaatagaaggaaaatgaaagaaaggggattttatggacaaagacattcatcacccgtttggccaccgggtcatcccgatgacttcgattgaaagcggaacaggcagagaattgctgccggatctctattgccttaccatccaaattgtcaatgtgtgcctgatcggcagggccggaaccgatgcatttgttctcgtggatgccggcatgccgggttctgccgaagcgatattttcagccgtgcgggcacgcttcggggaaaaggcaaaaccaaaagcggttttactgacgcacggccattttgaccatgtcggagcgattgcgccattattggaaaagtgggacgtgccggtttttgcacatcgattggagttgccctatttaaccgggcgtgaaacgtatccggatcccgatccgtccgttgaaggcggcctgctggcgaagatttccatgatttatccgaatgaaccggttgatcttggccatgctgtccagccccttcccgaagacgggacggtcccatttttgccgggctggaaatggatccatacgcccggccattcgagagggcatgtgtcgttcttcagggaagcagacagcgtgttgatcacgggggacgcatttatcaccgtcaggcaggatgaattttggaaagtgctggtgcaaaggcaggaagtaaacgggccgccgcgctattttacaaatgactggaaagcggccaaacgctcagttgaaaaattagctgccttaaagccggaaactgctgtttgcggccacgggatcccgatgtctggctccggcttgcggaaagggcttgaggcccttgtatccggatttgatgaaatcgcgctcccggatcacgggaaatacgtagatggcacacaataggcggtttgttcattgcttccttccccgcaaaggtttacaataatttgtaaatggatggatataaaggggcgagaaaattggaagtcaaagattttatgatccgggatgttattacggtaaaaaaagagacaacgatccgggaactgttaaaggtgcttgcccaccaccggatcggcggcgtaccggtcgtggacgcggaaggaaagctgctcggtatgatcagcgacggggatgtcatccgctttttgcagccaaaggcacggaccgtttacgatttttatattacgatcgtggtaaatgagcaggaagactttaatgaaaaattggtgcacagcctggacttcccggtggaaaagattatgaaacggcgggaactgtatacggtaaggcctgaagacgattttgaaaatgcgctcaggattctggcaaaacaccattttaaaaagcttccggtcgtcaatcaggcagggcgtgttgtcggcgtcatctcaagaggcgatatcatgcgccagattacggataaattgctcaacagctaaatcgcaatgtttagaccggcctccccggggaagactatacataacagtctttcggggaggtcaaatcatgaacggaacttcaatgccgcaatctcctgaaccgttgtggcgcaaaacggtcacgatgccgcaatttccatcgttaacgcaggatatggaagccgatgtggccgttgtgggtgccggaatggccgggattgtaactacctatttgctggcaaacgaagggtataaaacgatcctgtttgatgccggatccattgcaaatggcacaagcgggcatacgacggcaaaaatcaccgcacagcacgggctcatttatgatgaattgatccagcatataggaaaagaaaaagcatccctttattacaaagcaaacgaaacagctgcatcgttcattgaacaaacgatcctgaagcacgggatccgctgtgatttttcgcggcaggatgcctttctctataccaattccgatgcatatattgaaaaactggaaaaagaaatgcaggcgtatgaaaccctcggcatcccgggagaatggatcggttcgctgccggacgggattcccgggaaaaaagcggtgaaaatggccgggcaggcacagttccatccgctttcgtacttaaaagcactgattgaatatttaatggacaaaaatgtcccgatttttgaacaaaccactgcgaaagatatcgattttggcagcccattaaaaatcaaaacggaaaaagggcataccatgacgtgcaaatacatttgcatctgtacacactatcctttttacaatgcgaaaggcttgtatttctcaagaatgtatccggaacgttcgtacttgcttgccgtgaaacctgtaaaaccttttccgggcggcatgtacattaatgcggagcagccgtcgcgttcattccgggaagcggaaggagccggggaaaaactgcttttggtcggcggagagaaccataaaaccggccacggggaaccggagatccgccactatgaagcattgcagaagtttgcagaagaaacattcggaatcggggcattctgctgccgatggtcagcccaggatatgaccacattggataaaatcccttatatcggccccattaccaaaaatgaagaaagggtcatggtcgcaaccggattccgcaagtgggggatgaccggcacccatctcgccgccatgctgatgcgggaccggattatgcaaaaagagaacccttatgccgatatcttttccccgcagcgttttgaagcggatccgatggtcaaaaaattcatctctgcgaataccgacgttgccgggcagctcgtcaaaggaaaacttgacatgcgggatcaatctttagatgcgttaaaaaatgacgaaggggccgttgtccgtattaacggaaagcgggtaggcgcctacaaagaccaggacgggaacctctatctggtcgatacgacatgtacccatatgggctgtgaagtgaaatggaactcgggagaccgcacatgggactgcccgtgccacggttcgcggtttgcttgtacaggcgaagtggtagaagggccggcgaaagaaccgctgaaaaaaatcgatcaacaggactaaagtgctgcaaacaccgccgcaattcgacggtattttctgcttctatgcgcgaattcgtgactttatgcctatgttacaaatttttcacgggattacaaagaagcgtttttgtgtaaccaaatcaacattttgccgttatccgcctgttaaatccgtgtgttaggatttacggtgttggcacaaaagccggcaaaaagaggaggttacaatttatgaaaaaagcagtatcagcacttgcagctgcggtgacaatcacaagcgtaatggctgtcaatgcacaagccgcagcgccggatacttataccgtaaaaccgggggatacactttgggggatctctcaaaaatacaatacatccgttaaaacattaaaacaaaataaccaactttccaccgaaatgatttatccttcacaaaagttaaccatttccccgaaaaacgtttatgtcattaaagccggtgacacgctgtcggatatctcgaaaaaatacggcgtgccggttgaacaaataaaagaatggaacgatctgtcatcggatgtcattttcccgcatgatcaaatcgtgattcgttccaatccgaacagcaaagtgacagtaaaagaacgtgcagcggaagtttccgtccagccgcaaacaaacacggaaaatgcaaaagtggacgtgaaaaagccgaccgtgcacgtggaatcttccaaagaggcggctccaaaaccgcagggaaaaacgatgaccgtcaccgcgaccgcttatacagccaatgatccgggctgctccggcgttacagcgacaggcatcaatgttaaaaataatccgaatgcaaaagtgattgccgtcgatccgaatgtaattccgctcggttcaaaagtatatgtcgaaggttacgggaccgctgttgcaggcgatacgggcggagccatcaaaggaaaccgtatcgatgtcctcgtcccggattcaggaaaagccgccaactgggggcgccgtacgatccaaatcaccgtactggattaacaggcgtacggatggggatccgttacttgcacccgaaacattcaacaggcacagcaaaacagaaaacaaccattcaggaagtgacaatgaacgatgggggaaataccgcattttgaaacaccgcccggccgggtaaatccagtggaaaaggatttacccggccgggcgtttattttttcttggcagcgtgtgaaaaacattgtaaagtagagctagaaaaagaaaggagtgatctgtttgtcttttcctttgatcatcgctgaaaaacctgaccaggggcgcaccctttgctcggtttttccgcatgtgaaacgggaggggtatattgaaatccgcccgaatgagatcttcccggaaggcgctttctgcacatgggcgatcggccatttaacccagctcgccccgccggaacattacaatcccgcctggaagcagtggaaactggaaacgctgccgatcctcccggaaacattcaaatatgaagtagcaaagtcaaaatacaagcaatttcaaatcgtcaaaaaactggtgaaagacgcgcgtgtgacaaatattattcatgcaggcgatgccggccgtgaaggggaactgatcatccgcaacatccttcatttgtgcggcgccaaaaaaccgctgcggcgtctgtggatctcgtctttaaccccgcagtcgatccgggaagggttccgccatttattacatgatgaagacacccgccctttgtatgatgaagcatacgcccgcgcctgtgcagactggctggttggcatgaacgcctcccgtgtctacagcctgcttttaaggcgaaaaggcatgcgcgatgtcttttcggtcggtcgcgtccagacacctacgctcgctttaatcgtaaaaagggagctggaaattgaacatttcaagcccgaaccgttttgggaagtcaccgcaatgtttcaatttgatgacaaacaatacgaaggcaaatgggtgaaagatggcgaatcgcgtttgaatgacccggccatggcagcacggattgccgcattttgccgccaaaaaccggcggaagttgcagaattgaaaaaagaaaaaaaggaattccagcctccgttgttgtttaacttgtcatctttgcaggcagccgcgaacagggcttttcaatttccgccgaaaaaaacgcttgatcttgtccaatccctctaccaaaaagggatcgtttcctatccccgttccgattcccaatatgtgacaaaaggggaagccgaaacttttcccggtattttggaaaaactatccgcctgcccggaatatgctccgtatttcccgcttccaaagcgttccatccttcaaaataagcgttatgtaaatgagaaaaaggtttccgaccactacgcgataattccgaccgaacaggttgtggcaccaggcagtcttccggacggtgagaaaaaaatttatgatatgatcgtccgccgcctcattgctgtccattacggcaatgccgtttttcattatacgacggtgaaaacggtcgtggacagccgtgcaacatttctttccaagggcacgcaaatggaagcggaaggctggcgcaaagtcattttttcgaaagaaaaggaaaaagatggcattttgccggatgtaaagcagggggaaaaaggggttgtcatcgatacaaacgtcaaagaaggcaaaacgcagccgccgaaacggtacacggaaggccagctcatcacgctgatgaaaacggccggaaaatatattgaggatagggaactagaaaaagtcatggcggaagtggaagggctcggtacggaagcaacaagggccggcgtcatcaccattttaaaagaccggaagtatattgaggtgaaaaagaatcaggtctatgccactgataaagcgaaagtgctcatccgtgccattggcggcaaaattctggcttctccggaaatgactgcaaaatgggaaaaacggctccgcgaaatcgggaagggggcggcagaagcagccgcttttatggaacagacgaaaaagctgtccagaaaaattgtgcaagatgctgttcaggcagcggccgaatgggatttttccggcttaaaaacggatgacattaaaaggccggaatcaaaatatacaatcgggaaaaaagccggcaaatgcccggcatgcggcggcgacattgtggacaagggcgatttttacggttgcagtgcctatcggaaatcaggctgcacctttacgctgtcaaaatcgatccttggcaagaaaatcagcctggccaatgtaaggaaactgctggccggtgaagaaacaaacatgatcaagggattccgaaaaaatggcaaaacctttgatgcaaaattgaaatgggaggacgggaaactccggtttatttttgcaaagcaacaaaccggccgttgattattcaggggccggtttgtgcgaagcttgttttttcttccggctcacgaaaacggcaatggcaatgatgatcaccatgacgatgaaactggcataaaacccggggcgaatttctttttccgccagtgtcccgctgatcgcaagcagcaggaaaaggataccggctatggccgtgatttttccgccgccgtttagttttaaaacacggaaagccgaaaaaataataaatagccagttcatcagcagcaaaatcccggctgctgttgtaatgtattcataaattttccccggcagcaaaagggctgtaataatggaaagaaccaggccgcaagccgcaagcccgagcgaaggaagcggaaggtttttccatttttttatttttttgccgaaccattttggcgcatccccgtcattcgacaaggttacgagcaaattggtaaccccgaacagcgcggccgtcatcgtcgaaaatccggcaatgataatggcgccgttaaagacgtgggggaaaaaggtgagatgatagtccgccattgccttgacaaacggactttctttatcattaaaagccgtatagtgttccattgtgacggcaagcccgagcgagaccacgtaaatcatcgttagaacgactagcatgatcgatccggctttcggcgcatcttctttgtttttcaattgcatcgccatcagcccgatcacttcaatgccgccaaacgcataaaacgcataaatgagcgaagcccaaaagcctaacgcgccatggggaaaatagccgtggagaccatcagggaggcacccgcccgttccccgcccgccgtcaatccaaccaaaaagggcacaaaaggcaagcaaaataaacatgatgatggcggccgttttgatgacagcgagaatattttccaccttatcaaaaccttttgtgccaagcaggacaacaacaatggaaagggctgcgtaaatggcggccagtatccatagcggcattgcatgaaaccagaattttgttaaaatggacaatgcggtcagctggctccccataataagcacattcgaacaccagtaattccagccgcagctgaatcctgcccagttgccgtaagctttttttgcataataacaaaacgagccttcgtgtgggtcgcgtgccgtcattttcgcaagcgcgcggaaaacaatatatgtaccggcggccgcaatcaggaatgacaacacgatagaagggcctgtcgttttgatcccgatacccgatccgagaaaatagccggttccgatcgtacagccgacaccgacaagcgaaagctgccaccacgtcaggttgccgttttttgtcgctttagatggttgcttctggttgcccatcccggttccctcctttaccttacatactgtttgataaagcaggccggtttatgtacaagtccttgatgcttcttaagacagaagcgttttgatcccctgcacgccgaaatacaggccgaatccgattaaagacgcgccggaagcgaggaaaatgatttgcagtgtccggtgattgaaatagcgccggaatccgcccgtcaaaccggcgatgaacacatcccagatggcaagtcccacaaaaatcatgctgctgtatgccagcaacatgcccgtcccgtaatggccggcggttttggcaaggacagacccgtatatgccaagccagaacaaaatggataaaggacttgtgatcgacatgataaatcctgttaaaaagcatgcggcaagcggatctttcttccggtataaatcaacggtgatcgtttttgagctgattacactttccacgccggtataaatgaggataaatccgccaaacagccagagaaagacctgcaccatttcaatatttaaaaaccggacaagccccaagtacactgccgccataaaaatgccgtccgcgatcatcgacccggtcccgaccatccacgcatgccaaaaaccgtttttaatgcctttgtcaatgcgcgcggaattgaccggcccgatcggcgcagccaaagaaagcccgagaaacacatagccggcaaaaaggccgatgtccacatcccccactcctcccgaggaaaacttgtacattttatgcacgggcttgccttttcatgtatgccatgccttgacaaagcgtgttacccgttcgcttttccgccaccaacagtgaaaacctaaaaggaagagaaacgtttgatacagcaggcaagcgggaataaaaaagggaagagaaagggggaagacgtttgttacatctgtataaaaacaaggaaaacaactggaaatggtatcagctggaaagtgcggacgagaaagaaatcgcacggaatattgatgaaaacgaggaatgcaaaacatggattaaaaatataaaaaatgatgatacaaacactttaaagattgatacgacccaaaatgaccggccgtttgtcgaaggctcgcttatttttgaccagcacacgatcaaccgtgaggaacatgatatgtttcacttttacatcaccgaaaaaacgctgttgacggtagatcttgatttttccaagctgaaaaatacggaaatcgaaaaagtcatcgggcagatggcctattcccgcaatgccattgaggcattttttattatcatcggcgcgatcgtaaacaattacctagataaaatagacgaatttgaaattaaattaaacgaactgatctgggagatccagaaaaggaacaatattgacacgcttgataaaatatacgaacgccgccacgaactgctcgtctgccggaatttgatgatcccggtgaaagagatattatacggcatgcaggaaggatttggcactgatattttggaatacccgcaagtccggcaaagggtcatgaaaatcgaaagatgccttgcgcttttgcaggattaccaacaggaaatcgatacgctgctcaaagtggaagaagtggtttcaggccacaggggaaattcgattatgaaaactctgaccgttttaacgacgctgtttaccccgatttccgcctggagcgccttatggggcatgaactttaaaaacatgccggaactctcctggcgctacggctatattgcagcgctcggcctgattgtcgtaaataccatcctgctttatatctatctgtaccggaaaggatggacaggcgatattttaaaagggaataagaaaaaaacattatttaaatagcccttgctgaacgaatccgattctgagtttgtacccaatttgtcagtaagttctagaagaatccatctttaaaaatacgattctgtcttctctatacattgaatcagctttcaagtgcaagcttttccctgtattctttataaaacccttgtattaaatttatgccaaagctgtcagcacccttgccaaatctaggaattttggttatttttgcaagccctatgtgaagaaagcctggaaaattgacggcctttcttcacataggactcgtctacgttaaggaagcaagcaaaaacgaggctcttccttcacatagagtgcgtctacgttaagaaagcgcgaaaaaacgaggctcttccttcacatagagcgcgtatatgttaaggaagcgcgaaaaattgacggcctttcttcacatagagcccgtctacgttaagaaagcgtgaaaaaacgagggtttttcttcatatagagcctgtctacgttaaggaagcgtggaaaattggtggccttccttaacatagggtgcgtttcaagtgcaagcttttccctgtattctttataaaacccttgtattaaatttatgccaaagctgtcagcatccttgccaaatctaggaattttgctaattcagcaagccctaaatagcccttttccggctgcgggactgcccgcttttttttgcgcccgtttcattgatgtgaaagccaaattcctgtatgttaaaaacaaagaaaaaatttcaaaaggagcgtttccaatgaaagtgtacggcccggtggtagatgatgagacgcgctgcatccattatgcttctccgttggatgtcgtagccatccgttttaaatgctgcggaaagtattatccgtgttatcaatgccatgaggaagcggaagcccatccgatcgagcggtgggaaaaacgggaatgggatacaaaagcggttctttgcggcgtctgcaagcatgagatgacgatccgggaatatatgggggcaagcgcttgcccgcattgcggcgcgccatttaaccccggatgcgccgcccattatccgctctatttccaaatcgaccgggacaagccggcttgtcaaaaattttcaccttgaccgcttttctgaaatatggtatcttaaatgcaatcaaatcctttagtgtattagagtactaacataataaagagaaagtacaggatgtgaaaccgatgtttttaccggaaggcagccaggatgaaatgggcacggttgtcaaaaaccgcgcaaccgtgtttgaattgttccgtcgcacggcggagaagcggaattatacggaaatctcgacaccgcttgttgagtacgcggatacgtttacaaatgaaaaggttggcatgaagcttcaaaatatgctgaaatggtttgacagccgcggccagattgaagttttgcgcccggactggaccacctccatcgcaagggcgctttcgcaaaaaccgtttcgggcgtgtaaatgggcttaccagggttcagtgttcagaatggatacccccggccttgagagccgccaggtcgggatcgaaatggtagacctgccggaacttttaggggaaggtgaatgcctgttttttgcccatgacttttttaacaggctcggcgttaccggggtgatggtggagcttggccatgccggtatttttgaggaactggtcgcacgcctgaatctggaagacggccaggttgaccggttaagaggggccatgcacgataaacggaaagatgaagtattcgagattgcaagtttaagcggcaatgcaaaaattgccgcggaactggcgggacttgtggatgcgtacggtccgttcgaaatgatccggacatttcaggaaagatggaaaacggaaccggcactttcggatatgcttattcatatcgaaaagcttggtaaaatttgcatggctgtcggaatggaagacatcatgattgaccttggccgggtgaaaaatctgccctattataccggcattttgttccggggatttttaaaacaaaccggcgcttcctgcttttctggcgggcggtacgacaagctgtacgaacagtttcaccgccaaacaacagctgtcggcattgcttttgacgccgatatgctggctgaggaactggttcaggaagaaaaaccggaaaaaatctgcatcattgccggggaagaaacgcttgcggaagcagaaaagctgcgggctgcatacgacggaaaaatcgtggatatccgtttcgcgccgcctgcagaaggcgaattcagtaaggtcctcaagtttaaaaatgtgggcggccattgggaggcggaagaaatttgacgatcagcattgcccttacaaaagggagagtggaaaaacaatttttgcaatatttaaagtcgcgcggctttcatgttgaaccgctcgttgaaaaagggagaaaactcctcgttgaaacggatgcattcacctgcattttcgtaaaaggctttgatgttgcaacatatgtagagtacggcatttgcgatcttggcattgtcggggaggacattttggcggaaacgcatcccgatgttttcgatttaatgccgcttccgttcgggaaatgccggtttgcccttgcaggtaaaccggaggctgtccgccatcagcggaaacgccggatcgcaaccaaatacccaaatgtgaccgagcaatttttccgcgaaaaaggggaatcggtggacatcgtgaaactcgaaggctccgttgaactcgcgccgatcgttggccttgctgatgcaattgtcgacatcgtggaaacgggtaacacattgagagaaaacgggcttaccgtcatagaggagattcggccggtcacagcgcggctgatcgccaaccggtcggcgttaaaaataaaaaagcaggcaatccggccgtttattgaaaaactacagggagaaggggtcgcaaaatgatgcgggaatacacaaaagaagcatttgccgaaacgtttctgcaatcgaaagacaagagcggcgcgcacgatgaagacgtgctgcgcaccgcgaaggaagtactggaagacatccgattaaacggagatgccgccgtgaaaaaatatgccgccaaatttgacggggaagtgccggaaccgtgggaagtttctccggaagaacgcaaacaggcatggcgcgaagtcccacaggatgtgatttccgctttgcaaaaagcagcggaaaatatccgccgtttccacgcgaaacagctgcaaaactcccggatcatggaaatgaatgaaaacatcatttcaggtcagctgttccggccggtggaaaaagccgggatttatgtgccgggcgggaccgcctgctatccgtcatccgtcctcatgaacgcaatccccgctgtccttgccggcgtggaagaagtgatcatggcgacaccggcgagaaacggcacgaaaattgcaccggttttatccgtagcggccgatattgccggtgtcgggaccatttacaaacttggcggcatccaggcgatcggggcgcttgcatacggcacggaaacgattcctgcagtcgataaaattgttggccccgggaacgcatatgttgctgccgctaaatcgcttgtatatggcacggtcggcatcgacatgatcgcaggcccgtcggaagtcgccatcattgccgatgaaaatgccaacccggcgtatatagcagccgatctgatcgcccaggctgaacacgacgaacgtgcaagaacgtttttgttcaccacctcacagaaactgatcaatgaaacaaaagcggcacttgaaaaacagcttgttgtcctcccgcgccgcgacatcgcagaagtgtccatcaagatgcaaagtgcagccgtgcttgttgaatcgatagatgaagcctttgcactttcgaaccggcttgcgccagaacatttggaaattcaggtggaaaatccgctcttgcagctctcaaaagtgaaaaatgccggctccgtttttctcggtgaaaacacgccggaagccatcggcgattattacggcggcccgaaccacatcctgccgacatcgggaacggcacggttttcttccggtttgtctgttgacgatttttataaaaaaattacgtatttatattatggtgaaaaagctttacagcaagcggcgccggatgtgatggcgattgctacggaagagcggctcgctgggcatgcgcgggcggtccaaaaacgggtgaaagggtgagtgcgttgcagaaagcggcaaaaagcagaaaaacaaatgaaacatgtattgagattgccgtcaatctggacgatccggcggaagtgaaagtggatacgggtgtcggattttttgaccatatgctcgaactgttcgcgcggcacgggcgcatcggacttgttgtaaaagcggaaggcgatttgcatattgacagccaccataccgtcgaagacaccgggattgtgctcggccagctggtgcgtgaagcgctcggtgataaagaaggcatcacccgttacggctccgcttatgtcccgatggatgaagcgctcggctttgtcgccctcgacatcagcggccggcctttcctgcattttgaagcggaattcgaaaacccgaagctcggcaattttgacacagaacttgtgcgcgaatttttccaggcgtttgcgttccaggcggcggttaccctccacgccagggtgctgtacggcgaaaacacccatcacaaaatcgaatcgctgtttaaggcgttgggacgggcgcttcaccaggcagtggaagttgacccggaaatcaaaggcgtcaattcgacaaaggggctgatagaatgatcgcaattgtcgactacggcatgggtaatattgcaagcgcctcgaacgctttccgtacgcttgggcttgaggttgccgtaacggacgacccggaaaaactcgctgccgccacccacatcatcctgcccggcgtcggtgcatttaaagcagcagtggacgaaattgaaaagcgcgggctgcggccggttttaacggagcttgggaagaaaaagccgtttctcggcatttgcctcgggatgcagctgttatttgaaacaggatttgaaaatggtgttgcagaagggctcggctttattccggggacggtggaacggattcagacgaatgaaattttaccgcatatcggctggaatacgctcgatgtgaaaccgggttttccggcttttgcgccgtttcagcatcaacatgtgtatttcgttcactcctaccaggcgaaaacagaggcgccgtatattgtggcttcaaccgattacggggcggaaattccggccattgtcaaaaacgggaatgtgtatgggatgcagtttcatcccgaaaaaagcggcaaaaccggcatggcactgttaaaaatatttttgcaggaaagcagtttggaggtacaggcatgagaattatcccggctatcgatttaattggcggaaaatgcgtaaggctttaccagggggattttaaccaaacgacagaagtggcacccgacccggtggcacagctggaacgctttattgaaatgggggcggaaatggtccatattgtcgatttggacggcgcaaagacaggccggccggcacagtttgaactgattgcctctttatgcaagactgccgccgttccagtcgaggtaggcggcggcatccgcaatttggacacagtccatcaatatgcggaaataggcgtttcccggattgtgctcggaacggccgcaatcgaaaaccgggattttttaaaagcggcggtcgccgaatatccggagaaaatcgtcgccggcattgatgcaaaaaacgggaaagtcgcggcacacggctggcttgctgttaccgaaatggattacatcggttttgcaaaagaaatagaaagcctgggcgtttcgcgcatcgtctttaccgatatatcgagggatggcacgatgaaaggcccgaaccttgatgcgttaaaagcgctcattgaagcggtcagctgtgacatcattgcttccggcggcatcacaagcgaacaagacgtgaaaaacctggatgcaatcggcgtcaaggaaggcattgttggcaaagcgatttacgaaggcaaaatccggctcaagggggcggcacgatgatcgcaaaacggattattccgtgcctcgatgtgaaagacgggcaggttgtaaaaggaacaaattttgtcgggctccgcaatgtcggcgatcccgttgagcttgcaacattttattcggaaagcggcgctgatgaactggtttttcttgatattaccgcaacccacgaacagcgcgatacggtcatcaatatggtggaaaggacagctgaaaatgtgtttatcccgtttacggtcggcggcggcgtgcggacgattttcgacgtgacccgcctgttaaaggccggcgccgataaagtgtcggtgaactcggcggcgatcaaaaacccggacctgatccgaaaggcgtccgaccggtttggtgcgcagtgtgtcgtcgtggcgattgatgccaaaaaaactgcggaggggaaatggacttgtgtcgtaaacggtggccgcatcgataccggaatcgatgcgattgaatgggcgaaggaagcagaacggctcggtgccggggaaattttactgacgagcgttgataccgacggggtaaaagacggctttgacctggcgctgacaaaagcggtcgccggtgccgtcaaaattccagtgatcgcatcgggcggttgtggcaaaccggaacattttgccgaagtgttgaaagaaacaggcgcttctgcagcccttgccgcctccatttttcacgatggcacgtttaccatccgggaagtaaaagacatttgcagcaaagaaggggtgaacatccgtgaagcttgatttttcgaaagggctgattccggccattgtggtcgacgatgcgacgggggatgtgctcatgctcgcttatatgaatgaagaagcgtacgaaaaaacgcttgaaacgaaagaaacctggttttattcccggtcccgcggcagcctttggcataaaggcgaaacgagtggaaacacgcaaaaagtaaaatcgctccaggtggattgtgatgccgacacgcttttaatccgtgttgacccggaaggccctgcctgccacacgggggaaaggacatgcttttatacaaggctagatgaaaaaggggaagcggtggaagcggaaattccctccaaccggcgcatctttgacgtgctggaagaggagatggaaagccggaaaatcaagccggttgaaaattcctataccaattatttgtttgagaagggcatcgataaaatcgcaaaaaaatttattgaagaagcgggcgaggtcatcatcgctgccaaaaacaacagcaaatcagaactcatttacgaaacagcggatttgttgtttcatacctttgtccttctgtctaatcagaatgtcaaactatcggaagtggaagccgaactgcaggcccgttctgccaaaaaaggcaacagcaaaggcgaccggaaaaaaatcgaaaaatggtaatgaaaaaaggatgtccggataagggacatcctttttccattacttgatgccggcacggcagggttatttacaaacgcggatgtaataatacagcgtcgttccgtctttcactttcgagagcacttcatgcccatgccgtttgcacgacgccggcacgttaataaaagattgcgggcagtcggcgatcacttccaatattttcccgtcttctaatttttcgatggcctcaagcgtataaagctccggatacgggcatgattcgccacggacatccagtgttgcatccacagtaaaattttccgccatttttaccgcctcctgattacgcagacgttttcttttcgaataacgtgcgttttgcgtttatttttttcgtataccaattttcccgccatacgataagaagataaagggccagcagaaaagcgcccgtaccgaaaagcgccccgccccatccgaatgacgtgacaatattgacttccggccatcctttgacaaacacatcgaaaatgccccaatgatcccatccgtatgccaggagggttgccccaacgatattgccggcgccgactgcaaaaaattgcacttgcccctctgtaatgcggtacatccaccctgtttcacaacctccggcaatgacaatgccaatgccaaacaggacgccgccgacaagggcacccgggcttgcccagtggataacaggggcttcgcctttaaatatgaaaatagcggtgcctgccgtctggatcgccattcccacaatgatcgcttttccgagcgtgccccgcccggtcagccataaatccctgagcccggaagtaaagcaaatttggccgcgctggatcagtatcccaaatgccgccccgaacagtgcggcaagccccagcattattttaccggatatgagataccaggcggcaatcagcgcgataaaaagcaaaaccaaaacagcagcataaagctggtagttcccgtgttgcggatccggctgtgtgcttttggcagcatgccggctgaacgatatttttggttttcctttaaaaatgggcaatacggcaagtttgacgccaaaataagtaccgatcgcggtgccgacaataaagaaccaggcgtggagagaaaattgcggcagtcccgtaaaaaacgcagccaaattgcagcccatcgcaaggcgcgttccgaatccggcaatgatgccgccaataaaaccccacacccagcgccgtttctggcggggaactttccatttaaaattcttgctggcaagggcactgaacaaactgccaagcagcatgccgatgaccagccatccgtctgtccggtcctgcggctctccgatcagtttgatcgctttaaaatacgcccaatcagccgtatcgacgccgaacagctgaagcaaattccctccccagcgggtaaattcgcctgtgacggcccagagcgttccggtcagcccaaaataaaaagcagcaaacacgcctgccaacagtaagacaataaaaggattccaaaacccgctgaagtacttttcatgggctttttccaaccatatacgcatgcctttccggcctccttcatgaaaaatcatacattccctattatagcagagttttccgtcggcacattgataaaagtaaaggttgtaaagcggtttgctttttcaaatctgaaaataatggtaaaataatgaaacatatcatggggaaaggggggagatggcccggggacggcgtatacctggaccagcgaagcaacaaatgggaaacaatcaaaaaagcgggatgttatacaccttttttgcttattttttgtgggggctttttccgatttactggaaaatgattgagcaggtgcctgctattgaaattctcgcacaccgcattttctggtcttttatttttatgatcatacttttagcctttttaaggaaaatgggtgatttaaaaacgagcataaaagaaggggtccgccacccgcgcacgccgcttttattgcttctcgcgtccgtgcttgtgagcgggaactggtttatctacatatgggcggtcaacaacgggcatgtcattgaaacaagtatgggatattacatcaacccacttgtcagcatcctgctcgggatggtctttttgaaagaaaaactgaaccgatggcaatgtcttgcttttctgctggcagcgtgcggcgtcgcgatccagacgttcagctacgggcatattccctggatcgccatcggccttgccctcacatttgggttttacggccttgtgaaaaagaaagtggacattgatgcttttatcggcctgacattcgaaacattctttgtgatgccggttgcgctcctctacttactggtgatccaggtaaaaggcacggcatcttttgcaacggtttcaccgggattaaccgtattgttaattggcacaggcgttgtgacggcaatcccgctcatttgctttgcacagggggcaagaagcatttccctgacaatgatcggctttttccaatacttgacgccgacgatgacgctgatcatgggcattgcctttttcaaggaaccttttacgcatgtgcagcttttgtcctttgcttttatctggctggcgcttatcgtgttttccgtttccggttttttgccgaagaagaaattccatgtggaagaagttgcctgaggttgccatgccggaacgggtttactggaaaagcttttaaatgcatacaaaaaagcggcgggaacccacctggtttgtcccgccgcttttatatatgcggcaacttgtctgctaaaaaaggtattttaacaaatgatcttttcggccggcttttttttaacgggaaatttcaggtataatagggaagatcgaagtcacaagggagattggtttatgtccaggttccagttccgcccggcaacgtttaaaatggtttttttcatgtatttgctgggcacggttatttttgccattttgtatttgctgccggtttcacacaaacagccgttgctgccggtagatgcttttttcctgtccgcaagcgccattagtgcaacagggctgtccactgttaccgttgcgcaagaacttacaacggctggaaaaatcatcctgctcatccagatggaaatcggcgggatcggcgtcatggccttggtcggtgcgcttttaattgcattgcggacgaacgcgcctgttccgtctcaaacattgatgatttttgaccagaaccagaacagcagccgttcgatatccaaactgatggcctttattgtaaaatacacattaatcgtcgagacggcaggctttctgctgattctgccgtctgcactacagcacggcagccatgcttttgccgctttttttctttcggtgtcgacatttacaaacgccggctttgaaatttcgggaaacgggcttgataattttaaaggcgaaccgttcgtgcttgccgttttaagctgtatgatcattctgggcgtcctcgggtttgccgtcgtcatggagtttttgcagtcgcgccggaaaaagaaaagcctttatttcaaagtaaatgttttgatgcacggcattttgcttttgaccggctttcttttcttcttttttgtcgattttatacatatgccggggctttcttttacagaaaaaattatccagtccctgttcttcagtgcggcgccgagaagtgggggattggcatcgctcgatttgcacgttttttcttttccgtctttgctatttatggtcgtgctcatgtttatcggcgggtcgccaagcagctgtgccggcgggatccggacgaccacattcgccgtcattcttgccaaattgtggtctgttatccgcggttcaaatgagacacatatgttcagaaagacgctgtttgtcgaagacgtaaacaaagcctttctcgtctttttcgcttttctgtttttgttctttttctcattttttgtattgtcttttacggaaaaagcagcgccatttccgcttgcatttgaaattatgtcggcgctgtcgacatgcggcttttcactcgggatcacggccgggctgacggtgttcggcaaaatttggctggctttccttatgctgattggccgtctcggggtaattattttgatctatacctttatgaatcaaaaaaaatccacaatcaaatatgcaaaagaatccattttaatcggctaggggtgggattgtgaaacatttaaaagaaagttttctagtgctcgggctcggccgcttcgggtcaagtgtgctgaaagaattggcgaggctcggatacgatgttgtcggcgccgataaaaatgaaaaggtgcttcaagatgaggaactgcaggacgccgcatcgtaccttgcagaaggcgatgtgaccagcaccgcttttttggaagaattaaatgtaaccaattttgatgcggtggtcgtcagcatgggagatgattttgaatctgccattttaacggtgcttgctttaaaagatcttggctgtgagacggtttatgcgaaggcgaatgatcaaaagcgggggaggggcttgaaaggggccggtgcgacggacgtatttttccccgaagaagaaacggggcgccgggttgcctaccatattgcaaacccgggtattttgcagtatatccgtctgtcaccgtattgctccggccttgagatgacagtgccggaagattttatcggaaagtctctgacagaactcgatttccgcaacaggtataaagcccttgttgtcatggtcacttcccagactgaagaaacgccggttgtctcgccggcgccggattatatttttcagccaggggacaccattttcacagtcggtgcggaaaaagatttggaaagactgcgccggaaattttactagaaaggtgaggtattttccggctgcgttgaattgaactgcaggagctgccgtttttccggcctggggatcccattcggggcgtcggcacgggagccggaaaaatttatccgccgggggataagtctcctggcccctactacatattttgcagaaaaatcgttgcggttaaataccgccttgcgagcatttgaaaataagccgtaaaaacggaaagggtcgcgatgacgatggtgttgcggatggcttcttttttcgggtcgtccggcgatatgtatttcgatatcatctcttccgctttttcagtaaccataccttccattgctgaaatcatatgttcatgtttttcggccgggaaacgcccgacttcccgcatggaattcagctcctcgaaaagctgggaataagtggcatacagctgtaccggattaatcaaatcatcatgctcatcttcggggtcattgacgatcaattgcaacagcttacggatggaatcgaaatcgagcgccgttttcaagtcttccaccagaaacagtagcgccatctggtcaatcgaatattttttccctttttccggcgccacgatcatttctttaatatcgcgcttgacccagttttgaatcgcggtcagtgtaaaatttgtattttcaatctggcttccgagcgccacgatttcatttaacgaaaatccgaagtcatccgtgttcttcttcagtatttttgtaaagatggggggcattacagcagctgcaaaggggtgatgcgggtctttgccaccgtttttctttgcccataagccttgtaaaaacgttgcaggcgtcatggggcctgctcccttcagcgcaagtagcagatctgccatttccctgcgtgtcatttggaatagttccattaacagcacctcccaaacattggcatgctactttttatcgtaagattgatggatggaaaagtcaatgatgatgataagactctttgtatcctttcatcatccagcaattcgtgatattatatctatgggaagacctctctatagatgtttattttacggtgtacatttagataatagagtgtcttcccattttttctcctcatctgccccttcgagaaaaatttttacacatacggcgtgacaagatttctccggtgtcccggaatgccaaggatgccttattctttcaggtgaaacaatccgcacttttaggaagaaaattgcacctgtctcggtttgaaaacgtttaatgtcggcatttcagggaaaataaaaaccgggaatgcaatcttttgtcaaaaaagcttgcattttgattgataagttcatataataagttcataggaacctaatataaaaatagaaaaggggaaatgaagttgaagaaattttttgcgctgctcctggcatttacgtttgccttttcagttgtcgggattcacttttcaaacccggttgatgcaaggggataccgttctgtaaaacggtcttaccagacggtgccaaagacaacaacaccatcgtcaaaacaacagtcccattaccagtcgaaaacgaaccaaaatacaaattcggtttccggcaataaagccaatacagcgtcgtcttcatcgagaggcagctttgtaaaggggatgctgctcggcggtcttggcggcatgctgttcggatcgatgttcagccatctcggcggtttgggaacggctttgacggcaatggtcaatattttaatctttattgcgctgattctcatcgtcatcaaattgttccaatccgtattcggcaacaggaaaaaagatcgtgaggcttatgacagatggaagaattaaaactgtcagagcaagatttgattaacgcggtttgcacgtttgtggcagatcagcattatgcttatccggaaaatgtgatggcgatgctcacatacgatgatgataccggctacggcgcagatgtcgaactgaacggtaaagatctcgagccgctgactgagccgaaactgattcaggccatccgcaaatatttagaagaagaatacagcattgacccgtttgccgtcagtatccgactggaaattgaagatcaagatggcatggtggcatacgtagattaagaaacagcccggcaaatgccgggctgttttacactattttgatacatatttgtttcgtcctgcgccggctcctgcggcaagcatgaggatgccacagataatcatgaccacaaccggcatatgccagttatgcgcccggtcatacaaccagccgatcaaaaacgggccggctgccgccacgagataaccagcagactggctcatgccggacaaattggcagcttcagtggccgttttcgaacggaggccgataaacgcaagcgcgaggctgatgctggcaccctgggcgatgccgatcaaaatgatacaaatccacatccacaacatatgcccgccgtacaaaaggcctgtaagcccgcacaaataaaaaatcgtaatcccgaaaacaaggggaatctggtttttcatccgctccgcccaaatcggcgtcataaaagtggcgggcaggctgacgaactgcatgattgacaccatccagccggccgctacgaggcttgccccatggctgaccataatttccgcaagccaggcgatggtgctgtaaaatagaaacgactgcaggccgagaaaaagcgtcacctgccaggcgagcgaagacagccagaccgatcttccgggcgtttcctgatgggtggaaaactttactttggcgtgctcacgcaattgcgggatccacaccaaagcagccaggatagagaggatgccccagacgagcagcccccatttccacccgagccccaggccgttcacaatcgggacgctgacgccggaagcgagcgcggcaaatccgcccataacggttgtataaatacttgtcatcaacccgagttttgcaggcacccggtgtttaatgaggcttggcagcagcacattcccgatggcaatgcctgttccgataaaagccgtgccgatataaagcatggcggcattcccggccgtacgcgccaaaatgccgataaataatatgacgatcccaagaagcaatgtcaactcctggccaatccggcttgccagttttggcgcaagcggtgaaatcagtgcgaaggcaagaagcgggagcgttgtaataaatcccgcttgtgcatttgacatatgaaggctgtggcggatcgtgccgattacgggcccgatggaagtgattgccggcctgaggtttgctgcaatacagataacgcctgccacaagcagcccggataatactttttctttttctttctgatcacccatctttttctaaactcctttaaaactttcctgatttaaaaatggacagcaacagccataaaagcatcaatgttgcgacaccaaatccgatctcaatgatcgggtttttccagatcaccgtcgattggccgctgatggacgttccgatcatcagcccgaccatcaggatactaaaggcgagcaggacgatcgcgaaggaaagccggttgctgatcctgtcaagtttttccaaaaataaatgcaaatccggtatgacgacttccatcctgaatttgcctttccgcatcgttttggaaatatcgcgcaaatttttcggaagctcaagcaaaatttccgcctggtccaaaaacgttttccatcctttctgtgcgaccctgcccggccgcaaacggtcccgaagcagcctttccccaaatgggcgcgcagcttcgatcaggctgaattccgggtcaagcgattccacgacgccctccaccgtaatcagcgatttgccgagtatcgtcagatcggcagggaagcggatatggtatttgaacgcaagatggtataaatcattgatggcttcccgcaagcttaactggctgagcggcagatcataatatttttcgcggagaacttcgacatcttccttcagcagatgaagatcggtttcttccggaatttccgcaagcgcatcgaccgacttcataatggcattcgtatccgcccgcatcagcgcaatgacaagtgaggcgcaatggtacttggtctcttccgtaagccggccgaccatgccaaaatccatataacaaatcacatcgccgggcaaaacgacaatgtttcccggatgcggatcgccgtgaaaaaatccctccacaaaaatctgctgcagcatcgaatggatcagccgttcagaaatggctttttttcggtatccggggactgtttcactgaaaaattcgctgattttcctgccctttatgtactccatggtcaggactctttttgtggaaaagtcccagtaaattttcggaatccggatgttttcatcgccttcaaattgtttggcgatccgttccgcattccggccttcatggtaataatccagctcagacaacagcgcctgggaaaattcttcgacaatgtcccgcaattggtatgcccttgcccattcaaaacgggattcaagagagagagacaggctttccaatatttcaagatccgtttcaataacaggacggatattcgggcgctgaattttgatcgcaaccggttcttccgtatgcaatttggctttatggacctgtccgatcgatgcggttgcgatcggctccggatcgaattcggcaaaaagctcctcaacgcccgctccgaattcgtccctgataatcttttttacatcttcaaacggaaacggcgtggcattatcctgtaatttttccaggtcagcaattatcgattccggcaaaatgtcgcggcgggagcttgccagctgcccgagtttaataaaggtcgggcccaattcctccaaaaacagccggatcctttccccggtgctgcggtggggggtgcggggagccgcttttttcgagggaaaaggaagaaaatccgaaaggccccagtcgctgatcaaataaccgaggccgtttttaatcaaggcgccggcaatttcctggtatctttttccatgcttcatttttctggaaagcaagcaaccacccccggttttgttttatgcaaaaaaacagccggccctgggcaaaagggccaaccggtttacgggttcaaccgttcttcaagctgctggatgcgaagttccagcgccttgatttcgtcttttgtcgcaacattcatttcagaaaggatctcgttgacccgttctttcaaggcctgattcagttcttgtttagattgttcccctttttccagcagttcatcaatcaattgtgtcgattccgcttttgtcaagttgcctttttccacgaggcggttgactgctttttccacttgttctttgctgagcaccgccatgccaaggccgagtgataacaattggttcactttatcgcgcattccaattccttcctttctcctctatcttaatgtaatcatagcccaatccggccggaatcacaaacggaaaggtgtgaaaaatggccaatgaacggactactttccccagtgggaagcaataaacgtgtcgcggcccgatttcgcccggtcttcatgataggcattcgggtttttcttataaaaatcctggtggtaatcttcggcgggataaaaaggcttcgccggcaaaatttctgtcacaatcggctttttgaatttgccgctttctgcaagctgcttttttgaagcttctgccagccgcttttgctcttcattatggtaaaaaatagccgtccgatagttggagccgcgatcctggaactggccgccggcatcggtcggatcgatttgctgccaaaagatttcgagcagcttttcgtacggaaaaacgttcggatcatatgtaatttggacggcttcataatggccggtcgttccggtctttacttgttcatatgaaggattttcgaccgttccccccgtgtacccggaaacgactttttcaatgccgtcccactggtcgaaaggtttgaccatgcaccaaaaacagccgccggcaaaagttgctttctgaaattgttccgccatttcttctcctccaaaagtgatgctttttctaaatcgtaacatttcctgcgcatcacgacaagaaagaatgcccggtctgctgcggaaaaatcgaaaaattccgcctgcatttgcccaattttggattttagaacatatcttttttgtgttgtccactaaagtgcaaaaagtttttaaaaaaatgtgtttaaaatttgaacattttgtgaacataaagtaatataatatacaaaagggaggggttgtgaaatgaaggaatttaatgggtactatctgcttgcaaccgctgagctaatcatgagtgtggtttttcttgccattcactttattgtaagcgctcacacaacggactggtctttgattttgttttggggtttcctgctagggggaatgattacctatgggcttggcatggcatacttgatgatgctttgcgcatcagggaaagaattgccgcatgaatatccggaaggcgatccgtcatacagaaaagcgggataatcgttcgcatagcatgaaccctgtatacacggggtttctttttttggggggaagtgggcgccgatccattcggatttatgatggctgaaaaaatttaagcggcgggaaatacggcctttttcatgcaaaaaaacgatgccgcaaagggcaccgttagtcttctttttgaacatttgccgcctgcggaccgcgtgaaccttcttccacgtcaaacgatactttctggccttcttcaagcgttttatagccttcaccctggatggctgagaaatggacaaacacgtcgtctccgccttcccgttcaataaagccatagcctttttcactgttaaaccattttactgtaccatgttccacgtttaatgcctcctaatttttaacctttcttgcttttaatatatccagaatcccgggttttaaacgccatttctcacttgcaggcaaaatttgcggctttttttgctgtatctttataaaatgaacttcagtttttcgtgacaaaatcaattgcgatcgcgatagacattgctactggcaacatttacagaaatagtaatttaacttatatgccctgaaaatatacgccggccggttttcaccccccgttggtgcccggatccatcccaggcgtgggcgtccatttggaaaaaagcttggtacactttgcggcatcaacattgatataatcgggcagccgttgtaaacttttaaatagccggatagtgaaaacttcattgcaaaaggagctgtacccattcatgattgtttccggacaaaaggaacatcaactcatagaagaaacttttaaagatcaaatagatcatcccgctgtgatcagcaaaaagctcggacagtcgggtcaatttatggaagctgtccgcagtctggttgacttatgcggcgatgatccggaccgcgacggcttgcaggaaacgccttaccgggtgctaaaggcctttttggaatatacagaagggtaccgggaagacccgaaaatgcatttggcaaaaacatttgatgtcgaccacgaccacaaggagctcgtacttgtaaaagatatcgaattttattccatatgtgagcaccacttcgcgccatttttcggcgtcgctcatgtcgcctattttccaaatgaaaaaatcaccggcctgtcgaaaattgcgcgcatggtcgacggctacgccaggcgttttcaagttcaggaacggctgacaaaacaaattgcggatgcagtggaagaagtgcttgaaccgcagggcacgatggtggttttagaggccaagcatatgtgcatgtgcgggcggggcgtgaaaaagtcggatgcgtccacgaccacgatgtcttaccgtggcatttttgaagggcgggcggatttgcgcgccgaatttttgtccttactcaaatagaaaaaaggatggtgtttatgctagatgcggacatattgatcatcgggggcggccctgccggcatttcggcagcgatctggtgcagccggcttggcatgaaccatctgctcgttgaggaacagaagatgcttggcgggcagctcagcctgatccataatcgcattattgattatcccggcctgcaagcggaaaacggggaggaaatgcgccgctattttgttcggcatgccgagtcgttgcaatgccggtaccgggtgaatacgcgtgtcgtaaagatagatgccgaaggaaaagttgcggtggtggaaacaggcgggcttaagacccaaatcggttttcgctacttgatttatgctgccggtgccgtgcgtagaaaactcggtgtgccgggggaaaaagagatgttcgcccgcggggaaatttattcggctacgaaggacagccatttgtttaaaggaaaatctgctgcagtcatcggcggcggcgaccgtgcttttgagggggcttgtttgcttgccgaagcaggggcgcacgtctatcttattcaccgctcggaacgtttcagggccaggcaggcatatctcagtcgggcccaatcttataagaacatccggattttgccgaatatgcgtgtgaaagccattatcggggaaaaccaaaccgaagcggtggaactcatccattcaagcggtgaatcctgttttttgtcggtatccgcggttttcgtccggattgggatggaaccgaacagcgcactcgttcaaaatgttacggggacggatgcggacggatatattgtttcggacggttacgggaaaaccgaatgtgaatggctgtatgccatcggagacaactgccttggcccgctttattccagtattgcaggggcggccgggcagggggctgctgcagcaaagcatattgcctcccgtttggcaggggtacccgcacggtaaaataaacgatctgctaccggctttatggccccgcgcacgccggcataaagccgggtaatgcgtcccggtgagaagatggagcgttttcgcaaaaaacaacgaaagtgtacagaggcgatagtttataaaacatttttccccgtgccttttttgttttaatcccggccgccaggttgtgaggcatcttccccgcccagcacccggctgaatgcggcagaaactttttcatattcttcgtccgaatggagagcgtcaagatcgccttcttcgtctgttttcaagaaaaacacatctaagtcccggcctgtctgttcctctaaatcttcaacaaaagaaacggcggcatattctgttccttctagcgacaatacgccgatgatttccacttcttgctcacgtccgttttctgtaattgtaaacacttcaccctgttcaatatttgccatcgggtctcctccttcgcttcttgttcggtattgtatacaaaaacggaaaaaacatgccgaaaaaatacgcttatgatcgcagccgactatcggaaaggagtgtttatatatggataaaaaagacatggaagaaaaaatcattcagcaatacaaaatggatgagaaaatgatggcactcatttttgcccagtggtgcgtgaacaatgggcttgatccggaagaactttacagcagggcatatccgcaacaagaaaaaaatggcttgctggaagaagcgcttgccctaacggtaccgaaagaagaagcgggagaaatcagcaccgggactgtattgaatgtattatccttatttggcaatgacgatttggctttcgttgtgtcggaagaaaacgccaagttaaaacggtgagtccagaaacaaacctgcgtggagacgacccataatggtgttttttcaattccggaaatgacaaaatcaccccttggatgcccaaggggtgatcattataaggaatcgcgtatcgcctttttaaatccttcgacagagagcagggcaaaaaccgaataaagcaacgtatataggcccatcacgatcagcatcggtgtccacagttcggacccgaaaaagaaccagccggattttactgcaaagtagctgtgcgcaagaccgagcaaaagtggaatgccgaaattgtaaagctgcttgatccggatccctgttgttaaatcctgcatggtaaagccaagcttgcgcaaaatggtgtaggccggtttttcttcttcgctttcttccatttgtttgaaatacaaaatgcagccggatgtgaccaggaaagtgagtccaagaaatccgacaataaacatcataacccccatgttttctttttgcattttgatgatttcaggactggagtaggcaaaggaatccgaagggaaatgcagactttggaacaaccggtttgctttgccaagatcttcatcctttttcagattgatgccggtaaaaagattcgagtccaattgaatttttgggtccgtatccttttttaacgcctggaataatgcatcatccgttaccagaacgggcatgctgcctgaaaaataattggaaagaacctggtcttttcgaagggcaacggtgcgcagtctggctgttttccgcttgcccgttaagtcaatcatcccttccgatttcatcggcataaatctggctaaagcatcggaatagccggaaaaaaccgcctgcccgggttttacatccattccttttactgccgcatcgcttacgaccgctatcggtacagctttggagtcgaacttcagatcttttgactttttatcgaacaggctgcttaaatcggctgtaacccttacgacttcaatttcttctttttcataggcgatgttgttttcatttaaacgttctgtaaattgttttgcctcattcgtcttgataaatgaaaagtccgcagctgtcatattatgggctgtttcttcagcagaataaaaggtaatgtagcttaatgacaataagccgatcgcaagcgccgacacggttgtgataatggtcagcagcactgcgttcgaacggatccggaacatgatggcggatagtgacatgacatcccggatattcagatacccgcctttctttttccggatgaggtaaaagacaaaccggacagaagtcttataaaatagataggtcccgaaaataacaagggctaaaatgctaatcattgccgtatacagagcacgcactgttacaaagtctccattgaacaattctgatgaaatatagtatcctgccccgatgcatacaaatccgatgaccccgagcagcaatcccgctttggagattcgtccggcccggtcttccgtggaggaaacggtacggaaaagggaaaggatcgtctgccgtttgataaagatgctgttgatcagcaggaccaggatgaaaataatggtaaagacaaggagcgtctgcccgaaagccttcatcgaaaaataaagggaaacctttgtttccacttgaatgatccggagcagcagcatcatcagcagcttggatgccgcaaacccgaaaaagatgccggcaaagagtgagccgtagtagagcaaaaaattctccgtccctaaaatccggaacacttcttttttcgtcatgccgacaagctggaaaagcccgatttccttgctccgccttttcataaacaaatggttggcataaaagagaaacaccgccacaatgacgatcagcaaaaccgacgccaccttcagcgcggccagcccttttacggaagattttacttcggcgagagaaggggcgtattgcagtgtcacaaacgcaaagtataatgcagcactgaaggcgagtgcgaaaatatacagcgcataatgcggaaggttctttttaaaattgcggtaaatcaaaccgttaatcgtcatgctgcacacctcccagcacggcctgtgttttcaggatggcctgatagaaatcctgtcttgattcggtgcctttatgcagttgggaataaatctgcccgtctttaatgaaaatgaccctgcccgaatagctggctgcggccgcatcatgggtgaccattaagatggttgcttttcttttttcgttcaggcggcttaatttattcaaaaggtcggatgctgactttgaatcgagcgcacctgttggttcgtcggcaaaaataagacccggttcatggacaaacgcccgcgctgccgatgtccgctgcttctgcccgccggatatttcattcggatacttgtcctgaatatccataatgccaagttcttccgcaaccgcatggaatttttcgtccgcctcgcgttttgaaacttttttcacagacagcggcagcaatatattttccttcaccgttaacgtatcaagcaaatggtattcctggaaaataaagcctaaatgccttttccggaactccgccagctgcttgtctttcattttcgtcaacgccttgccttcgatttcaatggaaccgcggctgggccggtcaatagaggataaaacatttaacaatgtcgtttttccggaaccggacggccccataatgctcgtgaattctcctttttcaacatttaaatcaatcccttttaaaacttcttgtttgttccacttgttgccgtacgttttataaacattttttgcttcaaggatcatgattggctccccctttctgatatgatttcattatagaaaagccggcatgcttcttccttcgtttcagctaacaatacagaaaagcatatgacagttttgtcacatgcctgtaatttgctgcaagctatttctttccgggaagatgagcgtaaaggtcgaaccggcgccgggaaccgactggacagtaagcaggatatttaatttttccgccgcccttttggcaagatacaggccgaggccggttgcccccctgttttggctgcggtcagaagaggtaaatcccttttcaaaaatgcgcggcaaatctttcgggtcaatgccgcaccccttgtctgccaccgataaatggaagcggccgtctgccatttttccggaaatggagatgtctgtcccgcaactgtactggaccgcatttaccagcaattgccggaggataaacgacagccattttgcatctgtaacaattgccggaacccccggtgagacgtcaaaaccgatgcctttttgaatgcaccatggctgaatcgctttgatttcctggaagatcaggcgtttcaggtcaacattttccatataaacgtcattttccatattgccgatccgtttttcatgaagctgtttgtcaagcaggtggtggatgcgcagccattcataattgagcgacacttttgcttcttcatcttgaagccggtcaatgatgagctgcatggcggtcatcggtgttttgacctcatgtacccatgccgttaattcatcctgttcttcctgcaccgtggacgcgttccggtcagtttccgcccgtagatgttccgcctgcgcttgtacagcctgatgcacgatctgttcaaaaggggttccggggcgggtgatctcgctcgtatcaagatccccatcccattctgaaaggctttgataaaatttcacttctttccgagcgcggaagaaaaggaaaagaagaaaagcaatcgtttctaaaaaaacgatataaagaacggatgaaagcgcgatttgcggatcaagccaggcaatgaaaagcagcatcagctggcaggcggcaaaaaatattacccagctttttcgttcaacaagaaacatccggatcataggccggcatccttttcaagcgccatatagccctggcccacttttgtttcgatacagtcaccgagcccgatcgtggaaagttttttccgcaggcggttgacgttcacggtcaatgtattatcgctcacaaacctttcatcgtcccataaacattcgatcagatgcgtgcggctcacaatccggtttttcatgtccaccaatatttttaaaataaacatttcgttttttgacagttcaatgcatccatgttcattttcgaccgtgtttttctgcaaatcgattgtggccccgcaccatgtttttaaaaccgtctgctcgctcgtgtaggcatatacccggcgcaaaatagcctggattttggcgattaacacgtcgatatgaaaaggcttttgcacataatcgtccgcgccgagctgcatcgccatcaccatatctgtcggatggtcgcgggaagaaaggaaaaggattgggacatgggagtgcgcgcgaatttgtcggcaccagtggaacccgtcaaatttcggtagctggatgtcaatgactaccagatcaggccggaattccgcaaattcctccatcacctgtccaaaatcgcggatccccgcaacttcaaatgaccactgcgaaagtctttctttcacttcacgaaacagcgtcacatcgtcttcaatgattagaatttttatcaaccggaccactctttctatttttgctaccctccattttacaagaaaaggcgaaagcaggctacattaaccatcaacgagaaagcgcggcatacttccttttgctgcgctttttccttatcacttcttttagaaagcaaaccaatgctcttccaaatcacagaaaaaggaacgcaatgcccgaaagcgctaaaatatatgaatgataatcccagatgcgtgcaatcagaatgcttatcgagaacccgaaaagaataaattggtacctgtagaaaggacgtttttcgttggagaaacgcgggagatgcgtcaattggctgatggacgctatgcagtacagctgttaaaatcaacttaaatgaaaattttgaggatgtacaaatataaaaattttggtttattttccaaggaagatgggtagataatattgctttttaatagaatgaaagtagaaaggtaattttttttcgcggatttatgtactgtttgcagcgggctaaatgctggtattgttgaggtgagaacatgaagtttaaaagaagcgtaataatcatgatgatgctgtttttgttaggaagttgtagcttgatgccgaataaagcggatgaaaaaaagcaggcggaagcatcagagtacatgccgatacaagattacacggggcaaggttattcgtttgataacggagaagagacagggaaatttgcgaatcagcaccggaaacaaatcgttcaaagggtcaagcaatattttatccaaaaataccatctggatatcaccgtccatcatatatacggcgcaactgacgcggcagttgtttttgttgaatccaaaaaagatccgaaattccacacttccgtcatcgttggaattgatttggaaaacaaaaagattggcgatgtaggcgcctatgagggctctgttgaaggggcaattacaacaggtttgtatgtcatggcatatgaaaaggaatttcaaaagttagatgagttttgtgaagaaatggccaaaaaatatgctgttaccgggatgatgcaggaagcagtaaacaatacggtggataccggatatgcaactagattttattacacaagtacatcagacatcgattatccccaagtttataaaacgtttttggctcatccacacctttccaaacaaagggcaaaagaattggtattagaaaggcaatcaagtaaagattttaacgcggaaaaggatagcatttctattgctttaactttttatatgaagatgagaaatcaggcacctgatcaaaagatagctgatcaaatcattgaagcattgaaaaaagcgggtggactgcctccgggaaattatggtgtatttgtaaacagcaacgagatattaaaaagaacggggactgaaaaaagctataaaggaacaacaacgggcgttgatgacatcatcataaaacccgggaggaggataaaaatgaaaggagcagtacaatgactgattaagaatgaaccagattgacctgcttttatcaactatgtccccagcagtggtttaaaggtacggattaaacttttctaaaaaggaaactcacttttgtttggagtgtaaaccatgacttttaaaagaagtggaatcatcattatcatactgtttttattaggaggttgtaacttgatgccgaataaagcggatgaaaaaaagcaggcggaatcatcagagtacatgccggtacaggattacacggggcaaggttattcgtttgataacggagaagagacagggaaatttgccaatcagcaccggaaacaaatcgttgaaaaggtcaagcaatattttaacaaaaaataccatttggatatcaccgtccatcagatatacggggcaactgacgcggcagttgtttttgttgaatccaaaaaagatccgaaattccacacttctgtcatcgttggaattgatttggaaaacaaaaagatcggcgacgtgggtgcctatgagggctctgttgaaggggcaattacaacaggtttgtacgtcatggcgtatgaaaaggaatttcaaaagctggatgcattttgtacggcgattgcgagagaatacccggttattggtaggaccaaagaagctgtcgatcatacggccagcactggtttcaccactccatattactacacaagtacgtcggatttaatatttccagaagcctatcatgcctttttacataaagagagctaccagaatattatacatttaataaagcaaaaacctttcgataaggagggaatgatgattacgctcacattttttatggagaaaaaacatagtctcccagataaatcgatagccaaaggagtgattgataaattaaagaaatcaaacggcttaccaccggggaattatggtgtttatatcaaaagcaacgaaatattaaaaagaacaggaacggcgaaaaagcaggaaggtacgacatcagggatagatgatatcatcttggaacctagtaaatgaggtgtggttaatgagcattttaaaacaaaatgataatacttctgatcgagatcttattaaattgtgtggttttaatgtttatcaacagtctaaaaataagggaacacgctgccaatgtcaaacgatccttttctcacgtcctttattgacggaacctgtcggcgcgatacgcttttaaataaggacctgttatagctgaaaaagatggagggtgccgatcttgaattcaaaacacgcacgatggatctgatggaaccctttttggattttgtttcagaatcatgtgttgacatatcgttatttttcgatataatgatttgtatggaactcattgaagtcttcaaagccttatccaatgaatcaagattgcaaattttacaatggctgaaagaaccggatcgtcattttacgccccacgaagggattgatatgaatactacaggggtatgtgttagtcaaataacagataaattgaaaatgacgcaatccacagcatctcaatacctttccatactgcaacgagctgggttaattacggcagaacgtattggtaaatatacttactacaaaagagatgaagaagccataaaaaaaattgccactctctttgaaaagaatatttaaaaaatgaaactgaatcctgattatgaatgcagtttcatttccttaaacatatcgacatatcacgatatgtgtttttgtcgatacaaaacgttcaatcctgatatattttgatgatgaaggagtgatttattttgtcaaacactggtaagatctatatcttagcgatcgtaagttttttagttggaacttcgcagtatatcatttccggaattttggataatatttcagaatcattgggcattactctcgcggcagctggtcagttaataaccattttttcgcttgtatatgctattttcacacccgtattaatggctatcacctccagaatggataaacgtaagttaatgatatattcacttggtctatttgttattggaaatattcttgcattcgtccttcctggttatggattctttattgtatcaaggattattatggccctcggtgcagggatggttgtagtgacagccttaacgattgcagagaaaattgctccaaaagggaagaaagctagcgccatcgccactgtcatcatgggattgacagcatcattaatcattggcgttccacttggaagaatgacgagtgaggtactgggttggaaggctgtttttggagggattgccttacttggattagttgcgatggttattatttcgcttaccattccaaaaattcaggtggaaaaattgacacctttaaatcaacaactcgctttattaaaaaaaccaaaagtggtactcggattagccatcacttttttctggcttggcggatattccattgtttatacctacttatccccttacctgctaaatatttcaggtttaagtgacaaattgcttagcggcgttctccttatatttggtattgccagtctagttggatcaaagtttggcggatttagtaccgatcggtggggtgtgcggttcacactcattggtggcatgatgttacatatcaccatgctcgttctgttatcaatcgttacccactcttacgtgggcgtgttggtcatattaatattatggtcatttgcagcatggtctactggcccgactcaacaatatcacctagctacaatagagccggaatcatctagtgtattgctcggtctcaatcaatcaatgatgcagttggccatggcggcaggggcaggcattgggggtatctttgtagagagaatttccctcacttccattacctggttaggcgctttaggcgttacaattgcaattggattaacaatattgacttcacgttctccttctaaaaagacctcagtcgactgcaacgtcgtgaagtcgcaataaattgttagaatcgtaccttgttgtcaaattagtgaattgagagttcaaagcaaggaacgaataccaagtaagaatttctgctcatgctcagattgtagacaaataggggttcagaacttgtccctaagttctgaaccccattatgatgctcatcttcaaactcgtaaatagaatataaaaaatatactaaaataacaaattttaggttttgctcgctcatccaagtgtattgccccttataagtgggtacaagaaattatccggcaagcataatcacgtaacgatgacggagggataatgtatgagtgaacaaatccgaaatggtcaaaaaccggcaaaggggattgccccaaatgtggaacccgatgccttatacaatgataaaagaaaagttttcctctttggttccccaagctacacaaatatcggggaccaggccattgcctatgcagaggaaaaatttatccgtaaccattttccttattacgaatacatcgaaataatggattatgcgacggatgagggaattgattttgtgaaaaagatcattgggaaagaggacatcgtctgctttacgggcggcggtaatctcggcagtctctacctggacattgaagaagaccgtcgaaaagtgatctcggcttttaaagattataaaaccatctctatgccgcaatccgtttattttgaacctaccgaaaaaggacagcgggagaaaaggaaatcgcaggaagcctatggcagtaatccaaatctcaccatatgtgtccgcgaatcacaaagcctggaattcgtcaaggagaccttcaacgcaaatgtattgtacaccccggatatggttctgtcgttaaaaattgaaccgcaggatctaaaaagggatggcgtgctttttgtattaagggcggataaagaaaaagtgacagatgaaaattttgtctccgaactcatggaaagagctgcgaacatcgggcctgttgaccgcacggataccgttttatcaaaagtggacacgatcgattatgcggacagggaaacctattttatgaaaatgctgcaccggatcggctcgcgcaaacttgtcattaccgaccggccgcacgcgatgattttttcaattatcaccagaacgccgtgtctcgtattcggcaatagctatgggaaagcaaaacattcctatactgattggctttccaaattgaattttatccagtatacggacaagcaggatccggatgaactcgaaccgttgatcgcccgcctgcttcagacggaaccgaatgaaatagatctgtcggaagatttccaggtactgcgggattattttaaatcttaaaacgatgtacgcctatccgatgtcggccgtattaaacccacttttatgttcagcttgtatccgccgggcttttttaacaaggcgtgcatgtttaccacttgcctgcaaatagtaaaacaagggcgcaaaattaggcggggcagcctgacgcgcggtcccggctgaacgtgaatcaacaacaaaggagaatgcacatgaagaaaaaagatcgatttttggaaggcgcgaaagtcacgaaagacaatcaaatattcgggacaccgaacagcaaagcaaaagatggaactggaaactcaccgaacgatgatgtaagagaaagaaacaaccggtagcgggcccgatgcactgtttaaaaagactgctcctctttggggacagtcttttttaaaaacaaataaaaaaaggaatgtttaaattattctatgataataaaatacttgttccttgtatataaacaattgtatttcgggtaaaaacatattacaatgaaaaagtaatttgttataaagactgacaaagctatttttctattttttaagcatgtttgaaaaaaacagcgggagtgaatggcgtgaaagagagagcgttaaacagaggcttgcatgcgcggcatattcaaatgattgcgattggcggtacaatcggtgtcgggttgtttatggggtctgccagcaccattaagtggacagggccgtccgtgttgcttgcgtatgcgattgccggtatttttatcttttttattatgcgtgcaatgggggaaatgctctacgttgagccaagcacgggctcctttgccacattcggccatcaatacattcatccgctcgcaggttttctcacagcatggagcaactggttccagtgggtgattgtcgggatgtcggaaatcattgccgttggatcttacatgcaattttggtttccgcacttgccggcatggattccggggcttgtagccatggtgatcctcggaacggccaacctcgtatctgtaaaatcgtttggcgagtttgagttttggtttgcgatgattaaagtggtgacgattatttttatgattatcgccgggcttgccatcattttattcgggatcggcaacgggggtcatgccgtcggattttccaatctgtggcagcatggcggtttctttaccggcgggctgaaaggtttcttctttgccttatctttggtcgtggcagcttaccagggtgttgagctgatcgggattacggcaggtgaagcaaaagacccccgccatacattgaaaaatgcgatccaaaatatcatttggcgcatattgatcttctatattggcgccattttcgtcatcgttacgctttatccgtggaatgaactggattccatcggcagcccgtttgtggcgacttttgcaaaaatcggcattacggctgcagccggcatcattaattttgttgtcgttaccgccgcattatccggctgcaacagcggcatctacagtgctgggcggatgctgtatacgctcggcgtaaacggccaggcaccgaaaattttcacgaaagtatcaagcaatggcgttccacttttaggtacaatcggtgtccttgtcggccttgtgattggtgtggtgttaagctatatcgcaccgaaaaatctgttcgtatatgtatacagtgcaagcgtcctgccggggatggtgccatggtttgtcattttaatcagtcagatccggtttagaaagatgaaaaaggctgaaatgaaaaaccatccgtttaaaatgccgtttgcaccggtttccaactatgtaaccattgcatttttaatcgctgtcctgatcggcatgtggtttaatgatgaaacaaggatgtcacttgttgcgggcattgtctttcttggccttgtcacggtctgttactttgttttcggcattggccgtgcaagttcaaaaaatgcgaaagtgcaagcatccaaagggaaaaagatactggatcacccccaatcatgaacaaaaatagcgtgcgaatggagcacgctatttttgttcatttacgatggccccggctttcttcttcaaccgttcaagcacatgatccagttcgtccggctgcagaaattcaacgggggaaaaccctttttcaaagaggatggattcagactcgacgatcgtgacataccggtctccgattttggcgagatggaccgtttcgccaaaatcggaaaggagggcattcaccgaaatatggtccagtttcattcgcaaatcggcctccggggcagtttcgacaatctgggccgcggcttcgataacctgttccgccggcaatcgttcctgtaacgtccgcttggggcttgcttcccaaatctcaagttctttttcgaattgctcgtattcgatgctgtcttcatgcagcacttcctgaaaatgttcttccaccatcgtcttcacttgcgctttcatgatttccggcatcgattcgccgtattccacatactttaaaaattcttcgaaataacgggcgtgagatgcctggtgaattttcagctctgattcttcaatcatgccttcttccggcatatgcggatactggatggatttcatgccttttgtggtaatcgccatttccacttttttcaacaatgtggattcatcggcaatcgtggcgactttcggttcgaaatcgcatttcaacaaaaaaacaaacggttcatcgaagtatttccgcatcgttgcatttgcgatcagaaacgcgccgtccctgacagcattggtgtccagataggcggcgagaaaggcttcgcttgctttttgaaactcaccaatcgtgccggccatacgcgcacggttaaacaaattgaagttcgggttggagtcaaggccgtagcccggttccacaataaagcggccgattttcgtcggtacttgttcggacttcggatgcttatccactttcctttttacgattttttcaagttcgccatcgagaaagtcttttacgttacttatctcataattttcgcgatctaaagtttgaaagtgcctgaactgttttctcgtttgttcgccttccccgtctgtctggatgacatagaaggaaaggaaattgatgttaaaatccaatcgtttcacccggtttctcttttttcactgagcactattttacttgaaaaaacgggtttccacaatgtgcttgctggacgcggatgatttgcgggattaaaatggataggaaaacggatttttgaaaaaagaggtggagatttgcaaacctttttacatattctgcttttaagtacggttgaacttttcaacctgcttggaacgatcattgtggtcgggtttgtgctcggttttttggaaaagcgggcaacggccttcatttaccacgctttcgggtggaaggggattgcggtgacggcatggctcggtacgccggtccatgaatttagccatgccttgatgtgcggcattttcaggcatgaaattgtcgagatcaaatggctccagttgaaaagcggggatggcacgcttgggtatgtaagccaccaatacaacccggacagcgtttacaaaaaaatcggaaattttttcattggaactgccccggtgtatatcggcattttgattttgtcgctaggcatgtatgtgctattgccggatacataccggccgttcatgcaggcaatcagggcaggtcttcatccgtattccggcctcgaaagtttctttgcattttttggccattccatcggcgcactcgctagtcatcttttttcaatcgaaaacttaatgaacccccgtttttggatttttgctattgccggcatttgcatttccgcgcatatttcgttgagcaccgcggatttaaaaggggcatggaacggctgcctgtcaatttttggttttcttgttttcctgaatgtggccggttttctcttcggattccggacaaacggcctgattgcgcgcatctcggcttataatttatatattttagcgttttcgggcattgcgttcctgttttctcttgtttggatgagcattgggttgctttctgtatgggcaaaaaagatccgataacgaaaaagcgtggcatgcttccttttgccgcgctttttccgttacccctcgtgcacacgcagttttcttcttgaaggttgtaaaaggaacatcgatgcctcgaatcatctcttttttgataggcttcattttcgtagttgaatgacgcttaaatgcccgaagtaattgcaaccaaaagaaagctgttaatcaaaatactcaacacaatgaggatgatggttagaatcggaacaaatttcaagtgtttcgatgatttggatttagccagttttatatatccaatgaacagatagataatactcacgattgccaatatataaggtatcgaaaaggaaataatcggattgtgtatgatcgtaagtaggtcttgtacacctgctgataaaaaaacgaaaacaaggaaaaaatcaatgaaaccacaaagaaattcgtcttttttgatgacaaaatgatcacctctattcgactctacagttatactccattatataccattacaataaataagggcttgctgaacgaatccaattttgactttgtctcaatatatagaagaatggtgtatctgtgaaaatgcgtcaagctgccttctctatacattgaatcagctttcgagtgcaagctttttctggattccattgaaaacgatatccagtgggtgaaagaaaaagctggaaaggcggaatcagatgcttagagaaaaaggccaggcgtatgacacccctgacctcatccgtaaaataaaatttgacaaagaaaagcagcatttggatgcataatacattagtaagttgtatgctttgatgacggggtctcaaaagccgttaccttcctctattttataccgcccgggcacgcgcagtttttaagctgaggagaaagaaaaatgcgctcactgcaactaaaacagctgacaggataagaaaacgggctgttgacatgccgcttgcgaacacaacgccgagcacgaccgatgacaggatcgagcctaaataccggcatgtttggaaaaggccggagcttgtgccaaccatggcttcaggcgattcgttcagcattgccgcctgcagcgcaacattgccgatcccgtaaccgataccgaggataaacaggatcacacccatcagccagaccgaggcatggataaagaaaacggccatgaaaacggcgccggcaatcatagtcaaagcactgatccggatcggtccggcggttccggcacggtcaatccatttacccgaaacgagggaaatgaggatgcttgcgccggacataaagagcatcatgaacccgcttgtgtgcacgctgaaatgaagcccgtcctggtagaagctcggcagtccgaagaataagcagtaattaaataaattcagcacgatgaattgcaaatacacaacagaaagggaacggtgcttggataaaaagcggacatcaataaacgggcggcctgttctggcttcatagatcacaaataggacaagcagcacaatgcctgccacacccgtccaaatatggacagccgactccagttccaacagaaaatacagaagcagtacaagcccggccgcaaataagaaaatgccggtccagtcgagctcgtgcacaacatctttgaaagaagcatgtctgttctccggatctttcgggaagataaaccagccaagtagaaaactaatcacgataaaagggaagttcacgagaaaaatcgacggccagccgccaatcccgattaaaattccgccggcagtcggtccgagcgccgtcatggcagacgcaaaaatggacaaaacagcaagcgcagaggcttggttttcatgaatatgggtacgaatcagtgcgacaccggacggataaatagcactggaaccgatcgattggaaaagccgcatgagcagcagcacgaaaaaggccggggcaagcggcgcaccgattgccgaaacggcaacaagcaaaagccctgcaagaaacatttttttgcgcccgatcatatcgccgatttttccggtcacaggctgggcgaccgcgcttgccaaataaaaggatgaaatgagccacgacacagttgaaaaactcaaatggaaatctttttgaatgctgtgaagggcgagcgagatcatcgatgaattcagcgggttcagcatcgtaccagatgcaatggctgttaaaaaaaccgttcttttcgataaaggcatcacaatcctcctcgcttcagatgaaagccttctttctagagcatatcttttaccttgtcttccacgtccattcaaaacagaagtatcatacaacaaatatttcggggggtgcaaatattatgtcagtgaaggtccgcttttctaagcccgcctttttcgtgcagctgaaacaagccatcctgagtgctctcccaagccgcaaaaccagccaaaactgccggaaagcacctgcttagtaaacttgaaccccagcaatgaaacaaaagcggtttgtcctgtaagaatgcttcaaccctttacgtgaagcattccagtttgcgatttccgttttttctgtcataataaagaaacaaaaacaagaagaattgaggtaggaacatgaacgttaaaatcaatcggaatgccgcaaaaatgtttaaaaaaatattggaggaggaagatgcggaaggaaaaatgatccgcgtctttgtgaccgagatgcacggcgaccatgcccattacgacatcacgctggatacaccgggagaacatgatgaaattgtcaaaacggataagggcattgatattttacttgattcacgcgagccgtatttggacggcatctggatccagtatttttacgtgccgcaggaagaattcgtcattacaaacccgaggattgaacgcgaacacggtcatcaccatcatcattgattttttttatgttgaaaggcagtgctttttaaattggccagccatcaggcgatgcacattttgaaaaaggggatgaacaagatgaagcatcatccggttttactgttgtcttacggagagaaagaaggcggatagagacagaaatgacgggaggaggacgacggtttgtttagtgtattggggaaattagggtggttttttaaagcctattggaaaagatatgcgattgcagtgcttgcgctttcaattgttaacttgttggaagtgctcccgccgatgattctcggcgattccattgataaaatattcaccggggaaatgacagcacacattttttccctctacatcggcgtcatgctggcgattgcagctgccctttacggcctgacctatatatggcagtataacttgtttggcggggcgtttatcgtggaaaaaatgctgcggtcccggttaatgaaccattttttaaaaatggcgcctcctttttttgagcggaatcgtacgggcgacttaatggcgcggacgacgaatgatttgcgggcggtgtcccagacagcgggtttcgggattctgacgcttgttgattcaaccatgtatatgctgaccattattctgaccatggccgtgctgatctcctggaagttaacgctcgtttcgatcttgccgcttccgtttctggcagccggcattaaagtgctgggagagaaaattcatagacgttttactgttgcccaggacgcctttggggatttaaataaccgggtgctggaatcggttgccggtgtccgcgtcatccgtgcctataaccaggaaatagcggacgaaacaagattccagtcgatgacggaagacgtttatcaaaaaaacattgcggtcgaaaaaattgacgcgctttttaatccgctgacaaaaatcattaccgggatgagttacacgatcggccttgcttacggcacttatctcgtttttcaccagcaaattacactcggaaatcttgtttcctttaatgtctatttgggcatgctgacatggccgatgtttgcgattggggaattgatgaatgtcatgcagcgcggcaatgcttcacttgaccgtgtaaatgaaacgttgcggcatgtggaagatgtaaaagacccggaagccccgaaaacggttgaacagccggatatcatagaatttgccgattatactttccgctatccaaaatcgcgggaagagaacctgaagcatattcatttaaagatcaaaaaaggggagacgatcgggatcaccggtaaaaccggcagcgggaaaacaacgctgatcaaacaactgttgcgcgaatatccgcttggaagcggccggctgcttgtctccggtgttccaattgaacaattgaccaaagaggaagtattaagctggatcgggtatgtgccgcaggaccatgtgcttttttccagaacggtgaaagaaaacatcctgttcggtaccgattcggccggggaagcggaactgcaaaaagcgatccggactgcatcacttgaaaaagatatcgagatgctcccggacggacttgaaacgcttgtcggtgaaaaaggggtcgctttatcaggcgggcagaaacagcggatctcgattgcacgggcggtcataaaagatccggaaattttgatcctggatgacgcgctgtccgctgtcgatgccaagaccgaggcgtccattattgcgaacatccggaaagagcggaaaaataaaacgaccatcatcgcgacccaccggctgtcggcgattgaacacgcccagtggattgtcgtcctcgataacggccggttcacggaggaagggacgcacgaacagctgttgaaaaacaagggctggtattacgaacagtacatgcgccaacagctcaagtcccgtgaggaggtggaagcataatggctgcaaaacggcttttccgctatgcgatgaactttaaacgttccattttgattgcgctcgcggcccttatggttgccgttggggcggatgtgttcagcccgatcgtggcaaaaacgatgattgaccgccatatcaccggcattgaaagcgtatgggtggagacccatgatgcccgccaggcggtttcttatcacggccgccattacaaacggcttgtttatgcttccgctgaggagaaaaaagggaagaagcggacgattgtccaggcaggaagaaacttttatttcgtaaaaggccgtgttgaaaccggcgggaaaaatacgtaccgggacggaaaactgtatatgacctataatggcaaaacggcttcttaccgggcggaaaagatatcctatgcgggcgtgctccgcttttacagcccggaaatcccgtatattttgaaactgttaatcttgtatttcggcctttatgttgtgtcgggattcggccagtttacgcaatatttttatttgcaaaaagctgcaaaccggattatccagaaaatgcggaatgacctttttatccacttgcaaaaattgccgatcccattttttgacaacctgccggccggaaagattgtctcgcgcatcaccaatgatacggaagccatccacgaattgtatgtggctgtgctgtcaaactttttcagcggcctggtttatattgccggcatttatattgcaatgtttttgctcgactggaaacttgcgcttgtctgcctgttgttaatgccaattttatggctgtggatgcgggtataccggaagtttgcccagcagtacaaccggatgatccgttcgaaagtgagcgaaatgaatgccatgatcaatgagtcgatccagggcatgccggtcatccaggctttccggcgcgaaaagcaaacgaaggaaacctttgaacagctgaatcggacgcattttaaataccagaacaaaatgctggtgttaaacgccttgtcgtcccataatttaaccggcattttaaaaaatctcgtgcttgtggcgtttctctggtatttcgggcacagcgccctttccggtttgtcagccgggctctccgtcggccttttgtatgcctatgtggactatattaaccggctgtttaacccgatcagcaatattgtcaaccagttcagcaatcttgagcaggcgcttgttgccggcgaacgtgttttcaggctgctggacgaaaaaggcgaggatgcggaggcgaaatccgtaccgcgctttaaagggcatgtggagttccggcacgtctttttcggctacaaagaaaacgaatatgtgctgaaagacattgactttgaggcaaagccgggtgaaacggtcgcgcttgtcggccataccggatccgggaaaagttccattatgaatgtgctgttccgtttttacgactgtaatgaaggagaaatccggattgacgggacggatatccggtcgcttccgcggcaggccgtccgtgaacatatggcgatcgtgctgcaggacccgtatttgtttaccggcacgatttattcaaatgtcagcctcggggacccgcggattacaagagaaaaagcggctgccgtgttaaaagcggtcggcgccgatcaagtgatcggaaatctggaagaagggctcgatgaaccggtctttgaaaaggggagcactttatcgagcgggcagcgccagctcatctcgtttgcccgcgcacttgcttttgacccggctatcttaattcttgatgaggcgacgtccaatattgatacggaaacggaattggccatccagcatgccatggatgtcctgaaaaaaggaaggaccacgtttatcattgcccaccggctttccaccatcaaaaatgccgaccagattttggtgctggaccgtggccggattgtggaacgcggaagccatgaagagttaatggaaagaaaagggaagtattatcaaatgtaccaaatgcagcattcaggcggaacggaagcagccggataaatccagcaatgtgaagcggagtctgtactataacaaacgggcagggaaattctctgcccgttttattttttctttaattgttcctgcgccatccagaccagttctttcaccatgtttccgccgatcggcccgccgatttttccggcctgttcagccgtcagtttgccgttatagcctttttgaagcggaatgccgcgttcactggccacctcgtatttgatatcgtccgggtggtccgtatcggtacgatatccttctttggccatcacttcggttttgaaccggtcaagcgcgctccttgattctgcgataagcggttttctttttcgttttggcatgcggattccctccccttataggatgcggatggccagctgcctttatgcgccggggagaaaaaacgaaaaatgattttttttgaaaaaatcatacaggatatttaaaatctgtatggaatatttgtataataagaactgtaataatacagcaaataaaaagggagtatgcaacgtgaaaaaagcagtaattggtgcattgcagatcggtttgctctgggtcatttacgaaatcgggctggaagcagtcaaaatcctgcatttgccggtaccggggaatgtatttggcatgctggtgctgtttcttttattgatcacgggcattttgaagctgcagtggatcgatacgggcgcaacatggattttaaaacatttatcattcttttttattccgatttccgtcgggctgatgtcgctcggttcatttttcctccataatggcgtggtgctgatcgtaatactagctgtcagcgcggttgccggcattgtagggacagggatgtccgcccaacttttggcaagggggcgtgaggcaagccatgagcagcagttacgccgtgacactttatagcattttcatcaccgttttcgtttacctgttgtcgttgcggttatcgagaaggtttccttccccgtttacaacgcctgtatttttcagcacggccgtattgatcgtgttactaatcgcaacccatgtatcctataaagcgtatcttcccgcaaaaggggtcatgacctattttctcggtccggccaccgtcgcgctggctgtgccgctttataaaaacagggggattcttgcccgctatttcctgccggttgtcggcggcattctttcaggcagcatgctgactgtcgggaccgccctcgccctggccaaaatttttcagctgtcgcacaatatttttgcttcccttgccgtgaaatctgtcaccgtaccggttgcaagcgaggtagcaaaaatcatcggcggcaatgaggtgctggtcgccgggtttgtgatgattaccgggatgatcggcgccatgttcggcctgaagctcttatctttggcgcgcgtccacgacccggtatcgcggggccttgcgctcggcacgatttcccatgggattggaacgggggaagccgtgaaggaaggggagctgcaaggtgccgtatcaggggtggcaatggggatggccgccattttaacttcttttatcctgccatggttgttctaaaccgggataaatatatattacagctaaaggggtagatactgatgatgaagacgccgcttctactttcttcgatgattgagagggctgaacgctattttcccgagaaatatgtcatctcgcggacgcacaccgggattcagcggattccgtatcgtgaaattgcaaaacggacacgccggcttgccagtgcgctggaaaaactcgggatgaaaaaaggagaccgggttggtacgtttgcatggaaccaccaccgccatttggaggcctattttgccgtgccatgccgcggggctgtccttcatatggttaacatccgtttgtcagaagaccacctcacccatgtcattaaccatgcggaagataaaattttgctgatcgatgtagatctcgtcccggtgattgaaaaaatccgggatcgcctgaaaacggtcgagcattttatcattatgagcgatgagaaggcgattccggaaactaccttgtttcctgtctcctcttatgaagccatcctggaagaaggcgacgagcgttatccgtttttacacgaccttgatgaacatgcgccagccgcgatgtgctacacgtcggcaacgaccggctatccgaaaggggttgtctattcccaccgcggcctttatttgcacagcatggcgctcgggcttagtgaccagctcagcgttcaggaacgcgacatcgccatgacggtcgttccgatgtttcatgtcaatgcctgggggcttccctatgcagccacctggttcggggcaacccaggtgctgccggggccttcttttacaccggaaattctcgcacagctcattgaaaaagaaaaagtcacgatgacagcaggcgtcccgacgatttggatcggcatgctgaaagtgctgcaggaaaagccgtatgatatcagcagcctgcgcctgatcgtaagcgggggtgcggcatcgcctaagggattgatccgtgcttacgaggaaacgtacaaagtgccgtttatgaccggctacgggatgacggaaacgaccccggttgtttcgttggccacgttaaaaagcagcatggatcattttaccgtggacgaaatggtggatgtgagaggaaaaaccgggctgcctgttcccggcgttgaagtgaaagtcgtcaatgagaacggagaagtaccgtgggacggaaaaacaatgggggaactgatcgtaagagggccgtggattgcggatgaatattacaatgacgagcgtacgcaggaagcattcagggatggctggctgtataccggagatattgcagtcgtggatcaggaagggtacctaaagattaccgaccggacaaaagacctgattaaaagcggcggcgagtggatttcttccgtcgaacttgaaaacgctctcatgtcgcacgaagcggtctttgaagcagccgtcattgccgttccccacccgaaatggcaggaacgcccgctcggctgtgtggttttaaaaagcgaatatgaaaacaaaatcacggctgcggaactaaaagattatttaaaaacacaatttgcctcatggtgggtccctgacgacattttgtttatgaaagaaatcccgaaaacgtctgtcggcaagtttttaaaacgggcattgcgtgaacagctgcaagaccattatgcaggcgtgcagtaatgcatgcgggaaaaagccggaatctttctatggatttcggctttttcattcgataatataaaggggagaggttttaacggaaagacgaaaggattcaaacggaaatgcccaaaacatggaagaaaaagaagcggaaccggggtaaaacgtggatcgtcctgcttattccggtcatcgtgttaagcgcctattttattttcgaagagaacatccagaaaaaaacggatccccaaatccctgaaaaatatttgtccatctatttggaagcagagaaaatatacggggttccctggtatgtgcttgccgctcatcaccgggtggaaaccaggttttcaacgatgaagccgatggtctcgccggccggcgcccaaggcccgatgcaatttatgccgtgcacatttgtcggctggaaacatccgtcatgcagcggccttggaaaaggagacatcccgaaaaatgaagaaacgaacccggctgtcataaaaaaatacggaggatatggcgtcgatgcggacggggacgggaaagcagacccgtttaacgataaagatgcgattttcagcgcggcaaattatttgtcgaaaaacggggcggcaaacgggcagattcaaaaagcggtttttgcgtataaccacagccgtaaatacgtgtccgaagtgatgcattatgtacacctttatcaaaaagaaggtttagaaaaagcaagcaagtaaaaaagggcggttctggccgcccttttttactgttatgcttttcttgctattcttaaaatgaagcttaacacaaagacgagaatgatggccccgattaaagcaggtatgatggccatccctgcaatatgcggcccccaattcccgaaaattgcgccgccaagccatgcaccgacaatcccagcaataatatttccgataattccgcctgggatgtcccggcccatgatcaatcctgcaagccatccgataatcccacctacgattaaatatagaataaacgacattttcacattcctcctgttaacttaagtttcatgtctttttatcgaacttggtgtacttattaccttttttgtaccagactaaacatgcgcaggcgtattctaaaacgtctaaaatgacaaatatgcggaacttttcaggggaaagcgggaaatcctctggtttgaagtttatagatcatgcccgggattgtgcttttgccttgaatgattccggtttttaaccttttttgagccgcttaacggttccggctgcccgctgttgtttgcttttggctggtttctgcgtatatcatttccgtcgtttttatttaccattttcatccctccaactatacaatttgctttttgtaaagcggttatacagcataccatgaaaaaaattgaacatactatcgtttgaaggagagatgacaatgccttaccataaagacaaacagcaggcgttccaagcggccgagcagcacatggccttgacggaagacatcttgcagaatgtagagatgggaagtgaagacgccgggcaccagctcgcccatttgaaagaagaaatcaacgaaacgtaccaagagatcgaaaatgcactcgaagtggcgagcgaaacgcaacgggtgcaattggaacagttccggcgcgatttggatacaatcgtaaaacatacagatttgcattaaagcggggaggaggatccctgctttttttcatctgcgcccggatctggtataatatagaatggtatcaagcctgcgaccgggcggggttcatacatatgaaaaataataaacaggagggaatcgaaatggctttgccaaattttgaacagaatttacaaaaatatgcgaaattgctcgtgacaaagggcatcaatgtaaagcagggcgactgggtaaaagtatatattgcagtcgaccaggcaaaacttgcgcgccttgtcgtaaaagaagcgtatgcactaggcgcggaaaaagtaatcgtcgaatggtcggatgatgaaattacaaaacagcattatctgaatcagccgcaggaagtgctgacacatattccggattacaaaattgccgagacggaagaccatgtgcttaaccataaagtgagccggctgtctattctttcaagcgatcccggcctgctcaatgatgtcgatccgcacaaagtggccgcttatcaaaatacagcagcgaaagctttcaaagcgcagcgggttgccacgcaaaatgacgatatcaaatggacggttgctgcagcggcgggggccggatgggcaaaagcagtattcccggatttagaaaccgaagaagcacaagtcgatgcgctttgggatcagatttttaaaacatgccgtgtctacgcggacgacccggttgccgcctgggaacagcataaacagacgttaaatgaaaaagcggcgaagttaaacgacattcaattcgatgcccttcattatacggcgccggggacggaccttacactcggccttccgaaaaaccatatttgggccagtgcgggcagcgtgaacccgaaaggcgaagaattcattgccaatatgccaacggaggaagtgtttactgcaccggatacgcacaggatggaaggcgtcgtgcgcagcacaaaaccattaagttatgcaggcactttaatcgaaggcattgttgtccactttaaagacgggaaaatcgtcgatatttctgctgaaaaaggcgaagaagcgatcaaaaaactcgtgtttgaaaacgagggtgcaacagggctcggggaagttgcgcttgtaccggatccgtcgccgatttcacagtccggcattacatttttcaatacattgtttgacgagaatgcctcgaaccacctggccattggtgcagcctatccgacaacgatccagggcggcacgaaaatgagcgaagaagaactgttaaaacacggcatgaatgtctccaatgtccacgttgacttcatgatcggctctgctgatatgaatattgacggcatcaagcaggatggaaccgttgtgccggtattccgcaatggggactgggccatctaaagaaaaacattaatattatattgataaagattctcaatggccaaaacaaagaaatcagcccataaagctgatttctttgccatcccatgctactggtttttcttgcgttttttgttaaactgtctttctttttccgttaaaggctcgtttgaaaattcttcattgtatccggcgcctttcccttgcgcttttgccgtattcatgcccggccggatatggtttgctttctgtcttgtcacaaggctcacctccctggccacagtttcagtatgttgaataaaggaaaaatcataccttgccgataaattttttgcaaaccaaacgacaggtgatataattaaaacttatcacacacaataatattattgttatttacttatgtcatttcttgtaataagatgaaactgtgaggcgttttttacgaatcattctgttaatcttttaaatgatgaaaatatgaatcttgacaaagggggaaaagacatgtccaatgatgtctttaaagcgcgttccatttttgaagtaaatgggaaacgctatcactattaccgcctaacagcgctgcaagacgcaggaatcgccaatgtgtcgcgcctgccttattcgattaaagtgctgcttgaatcggtgctccgccaaatggacggccgcgcgattacgaaagaacatgttgaagatttggcaaaatggggatcggatgaagtaaaggacaaagaagtcccgtttaagccgtcacgcgttattttgcaggattttaccggtgttccagttgttgtcgatcttgcatcgctccgcaaagcgatggctgatttgggcggaaacgcggataaaatcaatccggaagtaccggttgaccttgtgatcgaccactcggttcaggttgataaatacggtgcgccggatgcccttcaggtgaatatggattttgaattcaaacgcaatgccgaacgctataaatttttaaactgggcccaaaaagcgtttgacaattaccgtgccgttccgcctgcaacggggattgtccaccaggtaaaccttgagtatctggcaagtgtcgtccatgaaaaagaactggaaaacggcgaatatgaaacgtatccggataccctcgtcgggaccgattcccatacgacaatggtcaatggactcggggtgctcggatggggtgtcggcggtatcgaagcggaagccggcatgctcggccagccttcgtatttcccaattccggaagttatcggcgtaaaaatgaccggatcgcttccgaacggggcaaccgcaaccgaccttgcgttaaaagtcacccagcttttgcgccaaaaaggcgtggtcggcaaatttgtcgaattctttggcccgggcgtctcaacgctgccgcttgcagaccgtgcgacgattgcaaacatggcgcctgaatacggggcaacttgcggtttcttcccggttgacgatgagtcgcttgcctatttgcgcttaaccggccgcagcgaagaacatgtaaaagtggtggaaacttacttgaaagaaaacggcatgttctttacgccggacaaagaagacccggtttatacggatgtgcttgaactgaacctttctgaaattgaagccaacctttccggcccgaaacgcccgcaggatttgattccgttatcgcaaatgcagtccgctttccaaaaagcgattacggcgcctgccggcaaccaaggtttcggactggatgaaaaagagctcgataaagaagctgtgatccattttaacaacggcgaaacagctgcgataaaaaccggcgcagtcgccattgcagcgattacgagctgcacaaacacttcaaacccttacgttatgctcggggccggcctgcttgcgaaaaaagcggttgaaaaagggctggaagtgccgaaatatgtgaaaacatcgctcgcgccgggatcaaaagtcgtgaccggctacttaaaagactccggtttaatgccgtacctcgaacaactcggctttaacctggtcggttacggttgtacaacctgtatcggaaactccggcccgttgaaggaagaaattgaaaaaaccattatggacaatgatttgctcgtaacgagtgtcctttccgggaaccggaattttgaaggccggatccatccgcttgtcaaagccaactatctggcttcgccgccgcttgtcgttgcttatgcgctcgcaggaacggtgaatatcgatttaaaccatgacccgatcggcaaagacaaagacggccaagacgtctacctgaaggatatttggccgcaagcggatgaaatcaaagaaaatgttcaaaaagtcgtcacgccggaactgttccgcaaacaatatgaaaacgtctttaccgacaatgaacggtggaatgcgatcgaaacgagcgacgaaccgttgtatacatgggatgcagaatcgacttacattcaaaatccgccgttctttgaaaatctctcgcctgaaccgggcgaagtacagccgctgtcgagcctgcgcgtcatcggcaaattcggcgattcggtgacaacggaccatatttcgcctgcaggtgcgatcggcaaagacacccctgccggaaaatacctattgtcaaaaggagtcgaaccgcgtgactttaactcttatggttcccgtcgcggcaaccatgaagtcatgatgcgcggaacatttgccaacatccgcatccgcaaccaaattgcaccgggtacggaaggcggctacacgacttactggccgacgaatgaagtgacgtcgatttatgatgcagccatgcgttataaagaaaacggcaccggccttgtggttcttgccggcaaagattacggcatgggctcatcgcgcgactgggcggcaaaaggcacatacctgcttggcattaaaaccgtgattgcggaaagctttgaacggatccaccgttccaacctcgttctcatgggcgtgctgccgctgcagttcaaaaaaggggaaaatgccgacacactcggcttatccggcaaagaaacatttgatgtccatattgacgaaaatgttaaaccgcatgactggataaaagtgacggctaccgacgaaaacgggaagaaaacggaatttgaagcgcttgtccgtttcgattccgatgtagaaattgactattaccgccacggcggcatcctgcaaatggtgctgcgcgaaaaactacagcagtccaaaaatgaagtgaaatcaaaatcataatgtttaaaaaagctgcggccaaagccgcagctttttttgaatcaaatttataatttttcccataattgcccatactaagtaaaaatacttgtaaggagtggcaaatatgagaaaaacccataaaaagaccctttcggatcttgttgccgaaaataaacaggaactgttgcgcgacagggatgcgctgatgcggatagaagaacggctggaccggaaacacgagatgaaattagcagaataagccactgtttgtgaatcataatccgctttcctcctggggaaaatgtataaggaggggggagatatgatgggcaacccaaacaagaaaagcaaatatttcgttcccgatcatcttggcacgcagccgcgcggattttccggcaataaggggaagaagatgcaggaccgttcgggacagcacgcccaggtgatacagacaaaaggggagtagctttcacagccgaaggaggagaacacaatggcgcataaccgaccgaaaccggacgaccgcagcgataatgtggaaaaactgcaaaacatgatccacaatacgatcgaaaacatggaaagcgcggaagaatcgcttgccgttacaagcgatgaaacgcaaatccaacaaataaaggaaaaaaatgagcggcgccgtgaaagcctcgaagcgatgagaaccgaggtaaaagacgaagccgcatacaaacagcagcaataaacgaaaacggcctttcgacggaaaacagcagcgtttctttggaaccacgccttttccctctcggaaaggccgttttttctctccttttgctgcgaccatgcgtgcatccgaagttttcccggccccgtatcaggcatccttttaggagggggaattttctttatgctaaaataaaattgactgtacatatgaaagaggtgtccgggatgtttgtatcagaaacagaagtcaaagtgcggtatgcagaaacagaccaaatgggggttgtgtaccacgccaattacctgatttggatggaagtggggcggacgaaattaatcgaagaccttggcttccgttatgcggatatggaaaaagacgggattttgtcgccggtcatcgatattcaaatttcatacaaaaaaccggcccgttacggggaaacagtgaccgtaaaaacatgggtcgatgcatatgacgggctgcgcgtaacgtacggctatgagatttacacagaaaccggcgaccttgccgtggccgcgagttcaacacatgtctgcgtaaagaaagacagcttccgaccggtttcgttccgccgcctctacccaaaatggcatgaagcatatgaaaaagcaaaaaaatcataaagcggggggatggatttggcttttggcatacaccgcaaccagcttaaagcgtggaaagcggcgattgaccgcggggagattgcgtttttaacgcatttttggctggacgaccgtttccccggcgcaaaatcggtcacaaaagtcggctgtaaagatctggagaaactcgctgcatggggagcacgctaccagctgaaaaaagaatggattcatgtccgtaaagacggttacagccatttcgacctgcttggcaggaagcagcgagaaattttgcaaaaagaagggcgccttgcggaagcaaaaaaatttttaaaatgaaaaaccggcatcactggcagcaaaaaagcaaaagctgccggatgatcccggttttaaccttttttatattcatataccggttcatcccgtttcgggtcatacccgatatacaaatcatggccgtcaaaataccattcgtccgtgccttcaatgaaaaaagcatggccgttccgttcaacggccgccaccggatcgtcgggaacgtctttttgaacaccaagtgaaaacccgtgttggacaggcgtggagccgccgtatttggcaaaaaaacggacggactcgccgtcgtccagttccagttcccttttaaaccagtttactgcctcatctgtaatgtgcattttcatgccgccacttccttccaactgccttttacattttcattatagaccaaagcacgtttttttccctaaccttttgccttcgtttaccggccccgggttataggaaacatcagatttagaaacaatggctgccttacagccacttgacttttggctcggtcttatttttaatccgcttaatattggctttatggcggtaaataatgaaagaggcaagcgccagaacgatgacgaacagcggccagtcatgtgttacaatcatataaatgagcgtatacaggatgccaaaaacagccgccatgatagaagaaagcgaaacgtatttgctccattttaatgtaatcaaaaaaacgatgatgaccatgacaaacaatggccattgataggcaagaacaacgccggcggaagttgccaccgctttgccgcctttaaatttggcaaataccggaagcatatggccgataacagcgatcatcccgattaaaagcgggtgcaccgtatgctccaggccaaaaaagtggggcaataaggtggcgattgtccctttcagaatatccaccactgttacgacactgccggctttgaacccgagcacacggaacgtattggtcgcaccgagatttccgctgccgtgttcgcggatgtctataccgtaaaaaagcttaccaacgatcaggcctgtcgggattgagccgagcaggtaagccaaaaggatcatcaggacaatattcatgtacaaaactccttggaaaaaatctatgcttattgtagcatgttcttaaaggaaagaggaatattttttgccgattccgtgcagattttctaaccgagcaggaattggaaaagatcaagcgaatgtttaagttgggatcagactggcgaaagtacaagaaaggagaggtgttgatcaaatggcaatcgaaaatccgagcagggaagaaatcagggaaattttacaaaaagcaaaacgaattgcagtggttggcttgagcaataacccggaaaaaacatcttatacggtagccaaagccatgcaggatgccggctatgagattattccggtcaatccgaaagcaacggaaattctcggggaaaaggctgtcccgagcttaaaagatatcgaaggccatgtggacattgtggatattttcaggcggcccgaatatttgccggagctggcacgggagtttgatgaaatcgatgcggacgttttctgggcgcagctcggcatcgaaaacgaggaagcataccggtttttaaaagaaaaaggctataccgttgtgatgaaccgctgcattaaagtggaacatgccctgacaaaataggctttttcaagcaggcgccagcttaaagggcgcttgctttctttatattttcccaataaaacggccgtttactggagaagtttttataaccgttgctttgcccctcccgttcccgtcatttccgcatgcccttttacaaattccgttttatcgttaaaatgagtatgataaaaacggcaaatgatgttataatgagaacgaatatttgttcttatgaacgccggtgcacgtgctttgcaattgaaaggggaatagatgtggcgaagaaacaaaatatattggaatataatgatgatgcaatccaggtgctggaagggctggaggccgtaaggaaaaggccgggcatgtacatcgggtcgaccgatgcgcgcggtttgcaccatcttgtctatgaaatcgtcgacaatgcggtggatgaggcgttgtccgggtacggaaaccatatcatcgtcaacattcacaaagataacagcatcagcgtccaggacttcgggcgcggcatgccggtcgggatgcacaagctcggtaagccgacgacagaagtgatcttgacgattttgcacgccggcggaaaatttgggcagggcggctataaaacgagcggcggcctgcacggtgtcggcgcgtccgtcgtcaatgccctgtcggaatggcttgttgttaccatacatcgcgacggttacgtgtatgaacagcgtttccgtgacggcggcaaaccggaaacaacgctcgagaaaaccgggaaaaccaataagaccggcacaacgatccattttaaacccgacccgtccatttttagcaccatcacttttaactacgatacattatgcgaacggctgcgcgaatcggcctttcttttaaaagggttaaaaattgaaatcactgatgaacgtttcgggcggcatgatctgttccactacgaaaacggcattgaagcctttgtccagtacttgaacgaaggaaaagaagtgctccatccggttgtgtttatcgagggggaaacaaacggaatcgaagcggaatttgcgtttcagtttaacgacggcttttcggaaaacattttatctttcgtgaacaacgtgcgcacgaaagacggcggcacgcacgaagccggggcaaaaacggcattgacgcgcgtcgtgaacgattatgcaagaaaaaccgggctgttaaaagaaaaagataaaaacttagaagggacggatatccgcgaagggctgtccgccattatttccgtccgcattccggaagaactgctccaatttgaaggacaaacgaaagggaaacttggcacaagtgaagcccgctctgcagttgatacgattgtttcggaacacctttcttattttcttgaagaaaacccggatacgagcaatcttttaatccggaaagccatcaaggcgtcgcaggcaagggaagcagcgaggaaagcacgggaagaagcgagaagtggcaaaaagcggaagaaatcggaaacgactttgtccggaaagctgacgccggcgcaaagccgcaatccgcagcggaacgaactgtatctcgttgaaggggattccgcgggcggttctgcgaaacaggggcgcgaccggaaattccaggctgttttgccgctgcgcggaaaagtcatcaatacggaaaaagcaaagcttgcggatatttttaaaaatgaagaaatcaataccattatttatacgattggtgccggcgtcggccctgaattcaatttggaagacgtcaattacgacaaagtcattattatgaccgatgccgacacggacggtgcccacatccaggtgctgcttcttacgttcttttaccgctatatgcggcctttgattgaagcgggaaaagtgtacatcgcgctgccaccgctttataaagtcagcaaaggcaccggcaggaaagaaatcgtggaatatgcttggaccgaaaaagaactggatgaaacgatcaaaaaagtcgggcgtggctatatcctgcagcgttataaagggctcggtgaaatgaacgccgaccagctttgggaaacgacgatgaatccggaaacgcggactttgatccgtgtccgtattgatgatgcggcccgggctgaacggcgggtgaccacgcttatgggcgataaggtcgaaccgcgtcggcaatggattgaaagccatgtggaattcgggcttgaagacgacaccaatattttagacaatgagaatttgatgattgaggaaggggacatgaacggatgaagacggctgaacgttttcaagatttgcctttggaagaggtgctgggcgaccgcttcggccggtacagcaaatatattatccaggatcgtgcccttccggatgcgcgggacggcctgaagccggtgcagcggcggattctttatgcgatgcatgtagagggcaacactgctgacaagcatttccggaaatcggcaaaaacggtcggcaacgtcatcggcaattaccatccgcacggggattcttccgtttatgaagcgatggtgcggatgagccaggactggaagctgcgaaacgtgctcatcgagatgcacggcaataacgggagcattgacggcgacccggccgcggctatgcggtatacagaagcaaggctcgctccgattgcatccgaactccttcatgatattgataaagaaacggttaaatttatcccgaatttcgatgataccgcaaatgagccggttgtgctgcccgcccggtttcccaacctgctcgtgaacggatcgaccggcatctcggctggatatgcaactgaaattccgccgcatcacctcggggaaatcattgacggggccatcatgcggatggaaaacccggactgtacggtagaagatttgatgacggtcataaaaggccctgattttccaacaggcggcattgtccagggaattgacggaattaaaaaagcgtatgaaaccggaaaaggcaaaatggtcgtaagaggcaggacatcgatcgaagagatccgcggcgggcgaaagcagattgtcatcgcagagattccttatgaagtcaataaagccaatcttgtcaaaaaaatcgacgagctccggattgaccggaaagtggaaggcatatctgaagtccgcgatgaaaccgaccggaccgggctccggattgtgatcgaactgaaaaaagatgcggatgcagatagcgtcctgaattatttattcaaaaacaccgatctccaggtatcatacaatttcaacatggtggccatccataaccgtcggccgcagctgatgggcctccgtgaactgctcgatgcttatattgaacaccagaaagaagtggtcacaaaaaggacggaattcgatctcaaaaaagcgcgtgaccgcaagcatattgttgacggcctgatgaaggcactttccatcctggatgaagtcattgcggcgattcgggcatccaaagataaaaaagatgcaaaagcgaacttaatcgcaaagtttgcttttaccgaaccccaggctgaagcgattgtcacgctgcagctctaccgcctgaccaatacggatattacgacgctggagaatgaagcggcagaccttgagaaaaaaattgagacctatctcgcgattttatccagtgagaaaaaactgtttacggtgatcaaaaaagaactgagagatatccggaaaaaatacgcggataacagaaggacaacgattgaagcggaaatacaggaattaaaaatcaatctggaagcgatgatcccgaatgaagatgtgatggtcaccattacaaaagacggttatatcaaacggacaagcctccgttcatataccgcttcaaacggccgggaccttgctattaaagatagcgaccgcctgctctttaaacagcagctcaataccgtccagacggtgctgcttttcacaaataaagggagctatatctatttgccggtccatgaactgccggatatccgctggaaagatctcgggcagcatgtttccaatcttgtgacgcttgaacgcgatgaaggcatcatcaaagtgctcccgattgaagatttcaaccagccgcagtttattttgtttttcacgaaaaacggcatggcgaagaaaacggaattgcagcaataccaggcacagcgctattcgaaagccctcgttgcaatcaacttaaagggcgatgatgaagtgctcgatgttcacctgacagacggctcgaaagaagtcttcctcgcttcccgcctcggttacgggctccggtttgatgaagcggaaatcagcgttgtcggccagcgggcagcaggggtaaaaggcatgaacctaaaagaaggcgacaggctcgttagcgggaaaatcattgaagatccggaaaaagacaaagtatttattgccacccaaagaggagccgtcaagaagatgaaagtgtccgaatttgacaaaacaagccgggccaaacgcggtgtcatcatgctgcgcgaattaaaagcccatccgcaccggatcgccggagccgtgattgcaggcgacgatgaaaccgtctcggtcatcacggaaaaagggcatcaggaagacattcggctccatgatttgcgcgaccatgaccgttattcaaatggctcatttgccattgatgaagaagagaacgggacagtggcagaagtatggaagcaggaaccggaagagggtgctgcggaagaaaacgattgaaaaaagtgtttgccgttttcggcaaacacttttttcatcttcaggcaagttttacataattctattcttgcggcgtatcctaaaggaaaacggatgcggggtgagaagatgaaaaaagaatacatgcttgcactgctcgcattatggtttatggcagccggcacggttgtgatcgcggacgcgggcgggaagacgaaagccggcaaaacggtgattcaccggtacgaggcggatgtaaccggcgacggaaaaaaggatgcgattgtattggaaggcatcccgtttgcagccggcagcccgtatatgaaaaaaatttgggcgcggattgccacgtcggaaggaaagaaatataaattgccgtatgagcctgggtatgaaccggaaatccagttcatcgatctcaaccatgacggcgtaaaggacatgcttggatcaagcaacagcggcggaagcgggggcataaaccagtaccgcctcgatacgctgaaaggcggcattttaaaacatttgccgatgccgcccgtgttaaagcttagcggcaaatttgaaaatgcattgtcggccaggctcaacattgaaaatacgaacgaaacatttttgattgatttaagaaaacggaaaaaagattatatccggctcggtatttaccgaaaggacggaatgctcaatgagccgtttgaactgatgatcgatccggcggcggtttacaaaccggtgaaaataaaaggcaaaaaaggcgtcgggctcgaaggtttccagcaagtaagcggtgcctaccatgcagatagactgggtgatgtaaaggcaacatggtattttaaagacggaaaatggatcctggttcgtgccaaatggcagcctacaaacgcataaaaaaactcccggcgggggagtttttttattgcggattcgaaaattgaaaatgtttttgcgcaaaaatagattataatagtaataaattacaaacaaaacaggggtagagcagattggacagacaaaaaagcaagtacagatgggttgtttttttcgcggtgctgttttcctacatggtgattgtcagccagcgaacggcgccaggcttgatttcggataaactgatgagcgagtttcatatggcagcgtccgtcatcggtttattgacaggtgcgcagtttctcgcttatgcggggctgcaaattccgattgggattttttccgaccggttcgggccgaacgtttttttggtcacaggcactttattcagtggcatcggcacgttcttatacagcatttcgccgaatgaagcctgtttgctcgtatcccgggtgcttgccggcatgggagatgcgaccatttggattaatcttgtcttgattttaagtcagtggttttatgcgaaagagtttgtcgggctgatcggttatgccggcatggccggaagcgtgggttctttgctcgcaaccgttccgctaacggcctggatttcagcttcgggatggcgccagccgttttttgtaaccggtattctgctcctcgcaagtacggtgatgctgtatgtcgtgctgatccgactcccgcaaaagcgggaagggggaacgcatgcgaatacaaaagtccgccatgaaaaaatgcttttggttctaaagcggatcttgaaaagcaggcaggcgtgggctgcatttttatgccatttcggccttgtcggcacatatgttggttttattggtacatgggctgtgccgtacgggatgcatattttcggcatgaaccgcccggaagcgagccagctggtcatgacaggattaatcggagcaattatcggcgcgccggttaccggatggatcgcaagcagactcggttcaaggaagaagccatatttgctgattcaaaccctgatttttctggcatggacggttttctttttgagcgggggcaaaccgccgttatttttcgcggtgctgttaatgtttgtcatcggatatggtaatggtgcaagcgcgctgacgtttgcggtcgtccgccactcctttgacgtaagggaagtcggatcggtttccggatttgccaataccggcggctttttaagcgcggtgcttttgccgagcttgtttggaaaagtgctggaccattttcatgctgaagcgagtgtggtcggttatcattacggctttttaatcccggcgttcttttcgctttttggcgtgctcgggacggtgatgatccgggagaaaatccgcgccggagagaatcaggcagcataaaaatttttaaacggtgcacagcagttgcctgttttacatgaaataaaaatttttaaaaaaaaccggtaaaatggttcacgcatccttttaaatgtgttatactaatgaacgataagtataacacatttgtcaaacagtgcatatactgatggcatacgggaggggcagtgaaaagaaaccatatacatacggagccattttccggttcgaaaaggatgggaaccatacatggaacaaaaagaaattgtgcatatcatctcggactcggtcggagaaacggctgaatttgttgtaaaagcggttgctgcgcagtttaacggcggacacatcgaaatcaggcggcatccgcatgtggaagaaacagacgatatcgaaccggtgattgagacggcaaaaaaacaaaatgccatcattgcttacacgatcgtcgttacccctttgaaagcatacattgaccgccgtgccagcgaagaagggatcattgcggtcgacctgatgaatccgttgatggaagcttttatgaaaaagtttcacaaggagccgtaccaccgtccgaagttaatgcgcaagctggatcaggaatattttaaaaaaattgaagcaattgagtttgccgtgaaatatgatgacgggcgcgatccaaccggactgaaaaaggcggacattgtcctactcggcgtctcccggacgtcgaaaacaccgttgtcgatgtatttggcacatcacagctttaaggtggcaaatgttccgatcgtgccggaaatcgcgccgcctgatgagttgttttccatcccacgggaaaaatgcgtcgggctgatgatatcgcctgaaaaactgaatgaaatccgaagagaacggatcaaagcaatgggtttaaaatcggacgccaattatgcgagctttgaacggatttatgaagaacttgtatacgcggaaaatttgatgcggaaactcagatgcccgatcattgatgtttcgaacaaagcggtggaagaaacagcaagccttattattgaaatgttcaaaaacagggaggagctgctcaaatgacaaaatttgtctacttgttcaacgaagggaacagccatatgcgtgacctgcttggcggcaaaggagccaatctggcggaaatgacaaacatcggcctgccggtgccgttcggattcacgattacaaccgaggcatgcaatgactattattcaaacggcaaaaaaatttcagatgcagtcgaaacacaaatggaagaagcgcttttgaaactggaagaaaaaaccggcaaaaaactgggcgggaacgagaacccgctgctcgtctccgtccgttccggctctgtattttcgatgccggggatgatggatacggtactgaacctcggcatgaacgatgagaccgtggaagccgttgcgaaactgaccggcaatccgcgctttgcctatgattcgtaccgccggtttatccaaatgttttctgacgtggtgctcgggatcgaggtataccatttcgaacatttgcttgaacaaacccgggaacaaaaagggtatacagctgatccggaaatgactgcggaagactggaaagacatcattgccggctataaaaagatcgttaaaaaacatacgaaacaggattttccgcaagacccgaaaacgcaactgtaccttgccgtaaatgccgtttttgattcgtggaataaccagcgtgccattgtataccgccgcctgaataaaattccggaccatcttgggaccgctgtcaatatccaaagcatggtattcggaaatatgggggatgattccggaaccggcgtcgcttttacacggaacccgtcaacaggcgaacgcgtgctgtacggcgaatatttaatcaatgcccaaggcgaagatgtcgttgccggtatccgcaccccgcagccgatccaggtactggcaaaagacatgccggaagtgtaccgccagtttgtaaaaacaagcaaattattggaagaacattaccaagatatgcaggatattgaatttacggtggaacgcggcaaactgtacctgctacaaacccggaacggcaaacggacggcgcaggctgcgatccgcatcgccgttgaaatggtgaaggaaggcattctcgataaaaagacagcgcttttaagagtcgatccggatcagatgaaccagctcttgcaccgccgcattgatggttccgcgactaaaaaccatcttgcaaaagggctgccggcatcccctggagctgcaaccggcaccgttgtgtttgatgctgatgaagcggaacggctcggcaaggaaggggaaaaagtgattttggtccgccccgaaacgacaccggatgatattcacggcattgttgcatcccaggcggttgtgacaagccgcggcgggatgacgagccatgcggcggttgtcgcgcgcgggatggggaaagcgtgcatctgcggctgcgaatctatgaaaatcgatttgaaagcaaaacaatttacggtcggtgacaccgttgtccgttatggggatgtcatcacgattgacggttcgacaggtgaagtgatgctcggcgaagtcccgatgattgaccctgagctttccggcgaattcaaaacgctgcttgaatgggcggatgaggtgcgcgatctcggcgtgcgcgccaatgctgacaacccaacggatgcgaaaaaatcgctcgaattcggtgcagacggcatcggcctttgccggacggagcatatgttcatggatattaagcgcgtgccgatcgttcaggaaatgatcctcgccgagactttggaagaacgcgaaaaagctttagataaactgcttccgatgcagcagggcgattttgaaggcatctttgaggaaatggccggccatccggtgacaatccgcctgctcgatccgccaatgcacgaatttttgccggataaggaagaactgctcgtagaagtaacaaaactgcagcttacggcaccagaatcaaaagaactggaagaaaaagaatacttgctgaaaaaagtccagcatcttgctgaattcaatccgatgctcggccaccgcggctgccggctcggcgtgattttccctgaaatctacgaaatgcaggtcaaggcgattttttacgctgccgctgccgttctgcaaaaagggataaaagttcagccggaaattatgattccacttgtcggccatgtgaatgagctgaaacggatgcgcgcgcttgtgacggacatggcgaatcaggtcatggaggaaaaaggcttgaaattcgattatacggtcggcacgatgatcgaaattccgcgcgccgccctcaccgcagaccaaattgcagaagaagcggatttcttctcgtttggtacgaatgacttgacgcaaacgacgttcggctttagccgtgacgatgcggaaggaaaattcttgcaacagtacatcgagcaaaaagtgctgccggaaaatccgtttgccgtccttgatcaggaaggcgtcggcaaacttgtcgaaaccggtgtcaaactcggccgtcagacaaaaccgggcttaaaaaccggcatttgcggcgaacacggtggggaaaaaagctcgatcgaattctgctacaaaaccggcctgaactacgtcagctgttcgccttaccgcgtaccgctcgcaaggctcgccgctgcacaggccaccatccggaacaaaaaagaagacaccgacaaagtgacagtcgctgcaaaataaatcattttccttaaggcacacggtggattgcccccgtgtgcttttttctgcgcaagtccatgaaataggcatgccgggggtgtaaagaagccataagcaaatcttatcaaatgagttgtcaaagccattatttaaatgacaaaagaatgaatgtaagatgaatgtaaggagggatgagattggcatttaattttatcgcaatcgaccatgttcagcttgctgctccacgtggcagtgagcagacagcaaaaaagttttacgcagaaatcctcggatttacggaaattgaaaaaccagcagaattgaaaaaacgcggcggctgctggtttcaaaacggaaaaatacaaatccacatcggcattgaagagcctttttcacccgccaaaaaagcgcatcctgcatttgaagtcagaaatctcgaaagcttgaaagaaaggtttacccactatcaaatgaagtggacagaagacggtaaactaccaggggcagcgcgcatttacgcaacagatccattcggaaacaggctggaatttttagaatggaagagcaagtaaaaaaacgtgcgaaatggtgaaatgagaaattggcagggggtggaatatggctgtaaattgcacaatgatgaaagcgaatctcccgtccggaaatccaaaatgcatgcatgcctgaccgggtcttggttaaagtaacaatgacgggcggaaaggaggcacgacatggacaatacgcatggatttgtgcagaagctgaatgaacagcaaaagaaacaggaacaaaacaaaaaacggcaggggaacggaaacccaagtgaaaagctgccgacaaaccggcattaaaaaaatggcgtgtgggatacacgccatttttcaaaagaacgggacagccacgctctaaaaacgggaattggtttacataataatattataaaaaaccacacatttcttttccgctgttgggaagatgtctgtttatcctgaaaatggaaaaggcagccaatcagatggctgactggttgcccatgttttcttccattttcatgcttcgcgcgatttgttgtgcatggcgcttcgcttctttcacggactttccttttaccgtaatcaatcgtccgtcaataatgaagttgaaaattctggttctcatatgctatcacctcttctttgtttacccattgttctttttttaaaacatatgcttctttcggaaagtttttcagaagttgaagatgcagtgagtagaaaaatattgcagcgggcagtttcatgttatccgtcgtgcgcagggattttttgcggaactcgggctttacatttatagaattataacagataaacgaaaaaaatacaacatattgatatggaaagagtttttctgcccatattttgaaaagcgctgcattcatttggacgggcaacaggagagggttttcactatttttaaaatgtttaaaataaatcagaatcctgttataatgggataaaggcgaatggggaggcatatggccacttttgtgatggatgtcgtgagttgaacactcgtcattttgcttgtttgctatatttttaggcatattgtagagcttccggtatatgtcattccggtattcagtgcggtatgcagcattgtgctcttgttcagcagctttttcaaaggaggatggggcggaatggggctgggtgcaatagggcttgtgctgttgctcgcatccgtcctgccttttatgctatccgcgttatttttaaggccgatggtggaaaaaaatcgtgagctgtccggaaaacggcggcacatggcatgctgctatcagaaaaacggaacgcgaagatcagtaacaagcattttacaagcaggactgtaagcgctatgatcagaaaaaaggtagaatggttttgagggaggaatttggatgttgaaaaacgttttgaccgaacggctgaaaatacggtacccgatgattcaggctccgatggcagggggcatcaccaaaccggcattggtggctgcggtctcaaacgccggcgggctgggcatgatcggggcggggtacttaaccgctgctcaaacaaaagaacaaatccgggaaatcaaacagttaaccggaaaaccttttggcatcaatctttttgttcccggcgagtttgaagtagatgaaaaagtaacagccgcaaatggcattttaaatcgggtccgcaaacagttaaaaatagaggcaaaagcggaaatagaagttcctgatttacatagcgtacaagatcaatttttggcacaggtgcaagtggccatcgaagagaaagtgcctgtttgttcattcacttttggaataccttccagggaagtgatcgaaaagctgaaacaaaacgggatcctcctcattggaacggcaacaaccgttgatgaagcgatcgaagtggagcaagccggaatggatatggtggttgcacaaggcagtgaagcgggaggccatcgcgggaattttttgaaagaacatgaggaaagtatgattggcctgatgtcactaattccccaggttgccgacaatgtccggattcccgtcattgcggcaggcggtattatggatggcagggggcttgcagcagcgctttgcttaggggcaaaaggcgtgcaaatgggaactgccttcctggcctgtgcggaaagcggcgcacctcagtcccataaggaagccgttctccatgcgaaagaagatgagcttgtcctcacccggtcattttccggaaaatgggcaagaggcgtaaaaaatgcattcatctcggaaatgaagccgcatgaagcgctttttccggattatcccgtgcaaaatacgctcacacaggatatcagaaaggctgccggaaagcagaacaaccgtgagtttatgtcactttgggccggccaaagcccgcgactcgcaaaacatcaaacggcaaaagcattgataggccatgtcataaaagaagctgaagaaatcatgggcaaaatgcctgaaactctataatttttcgccggcaatgaaacaaggcatcaaggcacacgagagggtgaatcattttcatgacaggttttcttgccgtgttttaggtggcgtggaaatctacgtgaaggaagcaggcgcaaaagatgatgtttcttaatgtagagtgcgtctccgttaaggaagcgcgtggaaaaaacgatgtttcttaacgtagagtgcgtctaggtgaaggaagctggggcaaaagtcggtatttcttaacgtagaaggcgtctacgtgaaagaagcgcggaaaaaagacgatgttccttaaaatagagtgcgtctacgttaagaaagcaggcgcaaaagacgatgtttcttaacgtagaaggtgtctacgttaaggaaacgcgtggaaaaaacgatgtttcttaacgtagagtgcgtctatgttaaggaagggagcgaaaaaattgatgtttcttaacgtaaaaggcgtctacgttaaggaagcgcagaaaaatgctggtctttcttaacataacccgcaaagtgaaggaaatgtgaaaaaatatcagcaggatctgctaagattgaaggaatagttgttatctataattttattatgttaactaaaaatatgaccatatcaaatgatcctcctattattgtctgcattgtaagccgaaataagcaggacaaacccggactgaagacgaatcatagcgtaaatagctgtgaagtgtgccaaagccataacaggtttgtccccctttccctttcgcaatttctcggaccaccttacgggcgtttgtcccacggttccagttgcccgacaatatgcctttttttgcctgactggatggcttcgatgacgccgtccgaaatttcttcatttgtcagccatcttgactgatgattttcgagaataaacccaagctggatttgatggtaattgcaattttccaaaccggcaagctcgttcaaaagttcatccggattccgggtgcttccgaggacgtgatacagttcccattggcggctgttctgtgaaaaaacatttgaaatcgttacaagtgcttgatctgcataagaatggatccaggctactgcaaggtcaaccggtccgtgctgcccaatcagtttatctaaatgttcacgcagtgcactcgaatcagcgtaatccgttaaaacaggggtaatccggctccggtcagcggcccgggaaatgcatgcatccattttttcgggattgcgcgcaataatggaaacatggtcagcctgtccggcgagccacagagatacattgcatagcatgccggttccgccgacgactaaagcgtgtttcaaggaagttcccccctgctttttatgaatagatatcctaagctctctgctgcccgcaaggaaagttaatggacttcccgaatttgcgagagcgggtaaaataccgcttcggtttttcccacgagttctttcttcggaataaggccgagcccgtttctgctgtcttcgctgtacaaccggttatcgcccattacgaaatatttatttcttggtacggtgagaggcccgaagttattcgtcaacttgctgccttttttacgtgctgctttcaggttttttgcaaggtaaggctctttgtgcaacttcccattaatgtagagatggtcatttttgactagaatggtatctccgggaaggccgataatccgctttacatagttttccgtttctcccttgatgatgatgatatcgcctctttggtaatcggcagcagaatggactttataaacgagaattttatcgtggttatgaagtgtcggctccattgattccccttcaaccatataaggggcaatgaaaaatcccctgatgaccgcaacaagcagaatggcaaatatgaatgattttaacaaggtttttatccctttgctcatttgaccagctcccatgcatatcttcatcgtattctattcttccagaaagacaggaaatcctttatattgtttaataatatgcaacatttccatgttataaacataagagatggggcacaggagcgatttgtgccattcaaggcggcgggaaattgcggaatcatccgccgtccgcgggatctcggaaagctgtaaaaatgcccgttcaacagtctttaggcaattcgcacaaatcatgagagctggtaaatttttttgatcacagcatctgtaaaagctgttgtggaagcagagccccccaaatcatgggtaacggtcccatctgcaatggtacccaaacatgcatcttccatttttttcgcaatttcattcaggcggggatcgcggtgatgtgcacttaaccattgcaacagcatgacagctgacagcagcatgcttgttggatttgcaagatcctgtccggcaatgtccggtgctgaaccgtgtgccgcctgggccattgcctgtttcccgtttgtgtttaaggaaggggataatcccaagcttcccgccaattcaccggccaggtccgacaagatatcaccgaataagttttctgtcacaatgacatcaaagtcaccggccctgcgcacgaggcgtgctgccattgcatcaataaggacatcttccactttgacttcaggataatattttttgccggtttcatagcaaatatcgcggaataacccgaatgccaatctaatgacattggctttgtggacaatcgtgaccttctttctccgggacatggccagcttaaatgcttcatgggcaattctttcaattgattttctggtaaaaacgccggttacaagtgctacatccggtgtaaccatacactctccggtaccgatgtacatattccgatcggataaaaagccttcggagttttcgcgtaaaattatcaggtcgctaaacccggcgacactttttgtcccgggaaaagtccgacttgggcgaatattggcaaataaatcaaagcaatgccgtaactcgccgcttggatttcttttgaataaacggtgttcatccggatatgcggaggaatcatgcggccccatcaaccagccatcggtttctttcagcccttgttttgtcacgtccggcataggatcattgtattttttaattccttcccagcccattggaagctctatgaaaacaaattcggttccgtttgctgcttttgaagctgcagctttcaacactttaacagtagcgcttacaatctcaggcccgatcccgtcgccatataatacacctaatttatacgttgtcatctttcaaactcctctcaactgttttaaaaaatcgaagggggtgcctggtgatcatcttgacttacaggaaggacagccgtattggggaagtgttcaatggatcatcggggctgaatttctaaaattactttgtcccttttctattattttagcattttataaaaatcagataaaggtttaaaatattgttgccaaagatcaagcagtcccacttccggcggaaaaatgccctgatttctcatggccagaggccgggcgtgagaaaaggggaaggaagagatcaaccggagactgcaatctgccagcaggggttatttggaaaccttttggattaaacaaaataaacgtctggcattttggacaaacccaaccggatccatttctgatccggttccttcttcattttgaaaaatggcgttgataatagaaattattgcagggatgatgataaagccaagccggatacccacccagtaatccctttgggcgcgccgcctaattgaaagtttttttgtaccataatccgccgctttgtattttgacgtaatcctcaataggcgagaataattttgtctctattttcgaccatctgttattgatcttccggcttttgcgattcatggtacttgctcatctttcctccccatgtaagtgcagatggtttgattccaatcacccggatgcgtttatagtctgcgatccagtgcccgtttttccacaaactgcctttcagttgtttttctgtattcgcaatgatcatttctgtttcctgttccgggatgccttccagcaactgcgtacaaaacattcggatccagtttttcaggccgtcttctccctccaacggtgtcggccggtcaaaatgcatagcgaacgtaacataaaatccggctttttccataaaagcggtatactcgccaatgctgggatagtaccagggaaactgttccggagagaactcgaacccggtttctgtgatttgctggatgagcgaagacgtgatcaattctacattacctttgccgccaaattctgcgacaaatcggccgccttgtttcaggctccggaacacaccttccaatgcggcgcccggttccttgatccaatggaggacagcatttgaaaaaacagcatcaaattggttcgtatagggcagttttgccgcattctgtacatcaaaagcgatgtctggatatttgcttgaagcctgccggatcatattttccgactgatcgatgccaacaatatgtgcgccgctttccccgattttataagataaatcgccggttccgcagccgaggtcgagaatgttttcgctgggttgcggagagagcagcccgatcaggctgtttccgtattccgatacaaatttgtgtttggtatcatacaattcggcattccaattgtctgctggcttcattacggattctccttctctattttgctgaaaagtaaaaataatatgggtttaaataaaatatatcatacatcaaaaggaaatgaggattgtaaaattttatttttccggattgcggttgctgcccggcacatgaattcgtttccaagagcagatcccgcgtgataaaatggttgtaatacccgaggaaaataaatgccctggttttaaccgtggcgctggtgggattgttattttcgtattactgaaaaaagccttaacaccggtttgcctgcttttgatccggttatcaatgtccggcttctctgctttgccatattggagattatcattttgctacaaatgaaaatattcaatttacaagaaggaattttgcatgtgtgcccacaatagttaatattagatgtatcgcttgcagacaggggatgatttttttgaaaatggctggcgtgatttttgtggttatcggtgtgattcttcttccgtttggcattttgcagtttaaaaaagaatggaaagcctaccggaaattttccccgaaaacccaaaaggtatttgtgctgattgaaatattcgatgtattatcgggtgtccccatcctgtcaacctggttgatgtacctttcagcattctgtattgtgatgggtgtcatcatgatcacaacgcattaagaaagatgatgaaaaacgcgaaaagatggcgtcctgcggttgttttgagccgaatggggagtacatcgccaagttgacataaaaaagcgctggagatgagggggcaactggatgttaaaaaaatgcttattggtgctgactgtatttttactggctgctgatgctactattttgtatatatggcttgccaaatggcaaaaacttgcaacgattcccggtatggtgggctggggaatagcctttttgtcaggattgcttttatatatgatcttaaaaaagttgagttccggagaaaaaatggtgatggtcttcagccggcttgcactcggttccgctgtcctgctttgcggtttagcggttttgacggttctcattacccttactgtccgctcaatgccgtaagagaggtatgttacatatcccatttgcaagaacaaaaaatctgcgggtgctaatctgatttcatgttgcccgcttatttttcagcttatcaataaagctgaggagttccactgtctgtttttttctgtttttttccattggggaaggagaagggggcggagagtaaacgcttgtttctttatggaactttttcacatgatcacctctgctgattatctgcaatagtgtatgtagagttgttaaaaagtatgaagggcaataaccagtttgttattgcccttgagaagattttttgccgtactttttcaggatctgttcgttttcttccatgatttttaaagtcgtcgggctgatgcccactgaaggaacacggactcttgattttcttctgaaagttccccgaatatttccggtttcatttctctgtgccaggagtgcactgctttttttcatttttgtcaccgccttgtttttcaatccatgtcgtccggcggagccgcaaaatcataaacatgggccatgatgacaaacaggatacaatccatttctgtaatggctctggaaccggatatttttaatagatacaattcgtcatgaaaaagataaatcggatggagcgcatcgtttccatcgacatgatacaccgtctccagcctgtccaattttgcgcggacggaaccgggatttttgtaacgatacaatgcctgatctttctctaacggtgttgtaaacggcaaaatattaacgctcatatccgctttttccgcataagatgacagtacttcttttaaacctaacagatatccttctttactaccataataccctacgatgccctcgttattcaagatgtcgagcatatttttagccattgacagattgtcctggatcagagactcatttgcagaaacggttttcgtaaatctctccaattcatattttccggctttacggaaatacatatttaaaaaaataaaaccgtcgattgctgcaaaaataagcgcggtgatggcatagtttttaaaatccgtgaaaatgctcgccggatggatcgtccagtaaaccagcgcgccaaataaataaaccaaataccagattttccggatcagaaaaacttttgcatccatcttttcttcattttttccatacaggtaagtgtatatcacgagaccggcaaaacaaagccaaacaaaagttttaaaaaacagcgtttccaaatctccgcccccctatattccagaaaagtactgtctgccattattttatcataaaaaggggaactattgtttggctttcttcataaaaggcagaattgatgaaatgttcctaggatgatagacggataaagagagatatgttagaatttaacaaaatatggggggagctggcagttttggaagcaaaaaacgcgttaaacatccgacaactgggaaacaaggaaaaactgccgatggatttactgctccttgccgacccgtcacgcgaaatggtgatggcctatgccaaacgcggggaatgctatgtggcggaaatcgaaggaaaagtgatcggggtttacatcctgctagcggcaaggccgggaatcgtggaattggcgaatgtggcggtttcaaaagaacatcaagggaaaggctttggaaaacggcttgtgctggatgccatccagagggcaggaagaaaaggatttaaatcgatcgaagtgggtaccggtaattccagcatcagccagctggccttgtatcaaaaatgcggttttcggatctccggggtggacagagactttttcgtcaggcattatgatgaagcgatttatgaaaacgggattcactgccgggatatggtacggttatcactcgatttggaagaaacgacatgtaaggggtaatggaattggaactggtcttttacaatgatgatttaaagcaacaattggacaactatacgataacggatgatcagctccgttttacggggcatccaaatgaagccattgccattgcaaaagaggatccggaacggcaccctgttgttgcagtccgccataacatgatcacaaacttttttgtgcttcatgaaaaaaatggcgccaggctctatacaaatcatccgcatgccatattgctgcggactttttcaaccgatttccaccagcagggaaaaggatacgccaggcaatgtttaaaacagctgccccattttgtctgtacccattttccggaaatagagcaaatggtccttggggtgaatgcggaaaatcttgctgcccaaaatttatacagacaagccgggtttgtggatgaaggggacaggatgatggggaaaaagggcgaattgatcattatgcattaccatttagacaaagaaggggtatacaggtgaaaataaaagaacttacaacccgggaagagtggaaagcggcgtttccggtgatgaaacagctgcggaaacatttggacgaagaaaacgatctccagctggtggaggcggcggcaaagacatcggattacaagatggccgctgtaatagatggcggaaacattgtggcggtaaccgggtatatgccgatgattactttgtacaacgggcggttcatttgggtatgcgacctggtgacggatgaagcgcaccgatcaaaaggatacggcgccaggcttttggcgtatgtggaaaaacaggctggcgaaaacggatacggcattgtatctctgtcatccggcctgcaaagaaaagacgcccaccggttttatgaagaaaaaatggattatgataaagtcagttatgtgtttttgaaaagactgtagtttttgcattttggcttaaaaagcgcagtttatcgccgtacctcttcatctgcgggctggccggtgtcataatgctgataagaatcaaaattgagttaaaaatgcggcaatctcttgacattgtgattaacttaatataaaatattgtcgaactggaaaactggagctagggttccgcttcattcagaaggtctgcgaccgagggcttcatctcttgtaataaaacaagaggcacctattgatataaaagatccgaggggaaaggttcagtgtatttcttatgcgctgattctttcccctctttttttattttttgaaggaggaatgaagcattgaatgtaatcgaccaaatttatccgggtgtagccgttgttctttttgatcaacaggaaagagtattacttcaaaagcgggcagatgttggaaaatggggtcttccaaccggccatgttgaacctggggaaactgtttcgcaagcagcaatcagagagatgcaagaagagacaaacttaacaattcggataaaacaaataattggtgtttattccgaccctgaatttcaagttttcaagtatcctgatggaaagtgtgtccattttatcaccacttgttttttggcggaaattgcaggaggaaagctgcgaaacaattcttccgaatctttagcactccagttttttcagaaagatcagcttcctgcaaatttattaaaaatggttccgctgtggcttggggacgctttagcaggctatgcaggtgcatttatccgataagatttaaacgaaaagaacaggagaggcagttaatatgaaacaaaaaatctttctgacagcaccctttaaaaaaacattataattgtaagtctccctgttgccaaatttcggataaaaacaacttccagcaagacctaaacaagaccgtccagaaaagatataccgtcattcttttggtcgtaaaaatgtaattaccaaaccaattgttttaacaatatatttcgttatcaaaaaatgtgaaaggtcgttttcaaatggaatcgaatgagaaattaaaagtcccatactcattagaagtagtgccaaaaaaggaacagcaaattgcttcgttgcagattgcactgttatggatcggagcaggattaggactggctgctattttttcaggaaatacactggcaggtcttggtttgacgaatggattactgacgattatcgttggcatgcttgtcgggtcagttcctatgtatttcatgtcccgcattggaacaagagagggagtatcaggtatgattgctacccgtgcttcatttgggattagaggttctttttttccgagcttgtgcaatgcgctgcagttaattggctggacagctgtgatgattctgatggcagctgaagcctgtgtatctttaaaatttgcaggaattcttgggaaccgagatttttggattatcttgattggtttgatcacaacggttaacgcgcttttgaaacacaatcatttaaaatggtttcagatatttacagttggtgcaacattgattttatccatcatcatgacctatgctgttttgtcaacagtaaatgttgcagacttaatggacaagaaacctaaaggtcatcttactttctctctcggattagattatgtgatcggcatgtgcctttcctgggttcctttggttgcagactattcccggtatgcaaggaatattaacggggccgcacacgctacatattggggttatgcgctatccagcatctggatgtactttgttggcttgctttgtaccattgctactggcctttggaatgcaagcccaattccaatcatgggtgcactgggcttgggtatcccaggtctgcttattatttttttttccactgtaacgacagcttttctagatgttttttcagcaggtgtttctgcaagcaatttatttccaaagttttcggagaggcgtcttgtattcattgcaggagtgtcaggcacactgatttcgctggtgtttccaattgataaatatcaaagctttttattaatccttggtgctgtctttattcccattgaaagcatcgtattggttgattattttttaatccgtaaacacctgaagctagcagacttgactaaaccagaaggatcgtactggtaccggggcggtgttaatctggtagctttcgtcgcttttgtggttggttttgctctctatgaagtcagctattttcaagcttggccaattggttcgtcatttattagtctgattattacggcagtcctttattatttccttatgagacttcttcatagggatcaattttcaaaggttagaagcagtggcatatacaagaatcatgcagcaggctgataagttattttcaaaaacattataacaaatggatgggatccaatctgtcaaatgcagaaaaaaataatactatgatcattttagaagaggtgtatattagatgagaccacaggtattaacaattgcaggaactgacagcggtggcggtgcaggtattcaggccgacctgaaaacttttgaagagaggggtgtctacggcatgtctgtaatcgttgccgtgacagcgcaaaatacaaaaggagttcagggaatttttccaatgccggttgacagcattgtccgtcaaatggaatccattgcggacgacttttcaattgcagctttaaaaacgggtatgctgtttgatgcagaacgcatagaagctgttgttgacggaattaaacgatttaaatggaggccgctggttgtggatccggtcatgattgcaaaaggtgggacacatctcgttgctcctgaagcaattgcgacgattaaaaagaaattggttccggttgctgatgtcattacaccgaatacaccggaggcggaagttctgtcagaaatgacgatacgtactgatcaggaccgggagcacgcagcacgactgattctcaaaagaggggcaggtgctgtgctgttaaagggcggacatgatctggttacatcagaaactgttcgtgattgtctggtgacgagggagcagacaatatggctcgaatccaaacgcattgataccgttcacactcatggaactggttgtacattgtcttcattgattacagctgagttggcgaagggccatcccttagaagacagcgtaaaaacagctaaaaaattattgacaagagcaatctctgagagcccgggaattgggcatggacatggaccaattgcccattgggtattaagagatgaagatggagaaagattacaaagctaaattcacataatataacccctgccggtgattttcattaagctttacaaagcataatagaaaagctataattgaaaaaagtaaatctttcaaactactaggggtgcccggatttggcgggctgagagaaaaaccggcgtttttcaaccctttggacctgatccggatcataccggcgtaggaaagtaggaatttgtaaaaaaatttcttgctgatgaagtcaggtcttttcgggcctggcttttttgcatgggaaggggtgggacaaatgaaactggatgagcaggtggttgtcgtcacaggcggaagcagggggttaggcaaagcagttgtaaaagcttttgcaagagaaggggcgggcgttgtcatcaactattttgagagtgaggggaaggcaaaggatcttcagaatattttaggagaaaaagcggttgccctgaaggcggatgtaagggatccggcgcaggtaagaaagatgttccggcaggccgaagcttatttttccaggcctgtcacgacaattgtaaataatgccctcgtgcatttccgctttgatccggaatcccggcacgatgcttcccgaatttcgtgggaggaatacagcttgcagatggaaggtgcggttcgcggcgcattaaataccatacaggccggccttgcggaaatgaaacggctgcatttcggcagggtgatcaatattggcacaaacctgtttcaaaatccggttgtcgcctaccatgattacaatacgagcaaggcagcgctcctcggcttcacccggagcatggcgaaagatctggggcaatatggcattaccgttaatatggtatccggcggccttctgaaaacgacggatgcaagtgcagccacatctgaagcggtttttcaattgattcaggaaactactccgctgcaaaaggtgacagaaccggaagacgttgcggatgccgtgttgttttttgcatcgccatgggcgagggcggtaaccggacaaaatctcgtcgttgacggcggacttgtaatggattaggcggatggaccttaccctgcaagaaaatccccatttagaggtatgacaacgattaggtgtaaatcaaatgcctgtgaaatttggagaatacgcgagtaaatgagagacaattgtactttattgaaggagggaatggaaatggaaaaagaaaaaccaattgaactgcttgaaaaaatcagggaagccaatccgcttatccataatatcacgaatattgtggtggctaattttacagcaaacgggctgttggcacttggcgcatctccggtaatggccgatgcggtggaagaagttgccgatatggcgaaagcggcaaatgcggtcgtgttaaatatcggcactttgaacgaaaaagccgtcgaagcaatgattttggcgggaaagtctgcaaatgaaaatggcgttccggtcgtccttgatccggtagctgccggttcaacccgttaccggacagaaacggcaaaaaaattgctgaaagaaatccgcttcacatccatcaggggaaatgccggagaaatcgccaatctgatcggaatagatgccaaagtaaaaggcgtcgatgcaggagataccggcctggatacgggcgaactcgctttaaaagcggcaaaaacgcttcatactacgatcgtggtaagtggcaagacggatgcggtgtcaaacggtacaaacctttatctcgtacataacggccacccgcttttaacaaaagtcaccgggacaggctgccttttgtccgcggtttgcggcgcttttctcgctgttgagaaagatccggtccaggcatctgtttcggcgcttgcgatttacggcgctgctgcggaaatcgcaagagaaaaaacaggcggggatttgccgggcagttttcaaatggcgtttttagaccagctggcagaaataggagctgaagaaatccaaaaatatgcctcttttgaaaagaaagaagggtgaacatcatgaaaaaagcactcacgattgccggttctgattccgggggcggtgccggcatccaggcggacttgaaaacatttcaggaattagaagtatacggcatgtccgtgattaccgcggtgacggcacaaaatacacgcggggtccagggggtatttccgcttggtcccgaagcagtctcccgccaattggcgtccattgccgaagatatggggacagatgcactaaaaaccggcatgttgtttgattccggcatcatcgaagtggtcgcggaaaaaatcaaagcctaccactgggaaaaactcgttgtagacccggtgatcattgcaaagggcggggaaacccttttgcaaaaggaagcggttaaagccttaaaaagccagctgcttccgctcgccttcattgtgacgccgaatcttccggaagcggagaaactggcaggaatgcccatccgaaatactgatgatatgaaggaagcggcacgcatcattgcggattgcggtccccggtattgtctcattaaaggcggacatcatgagtcttccccagtttcgagcgacttgctttttgacggggcgaacttttacgaatatacagcgaaaagatacgtaactaaaaatacgcacggcaccggctgtacgttttcttcggcgattacggcagaattggcaaaaggcgcggatatatttgctgctgtgtcgacagcaaaagcattcattaccgcggcgatcgaagacggcattcaaattggacatgggcacgggccgacgaaccattgggcctaccaaaaaaggagaatgaataaccgatgacaggcgaacatttgcgtgacgcattgaaactgtattttattatgggcagcccgaactgcacgctgccgccggaacaagtgctggaaaacgccatcagaggcggcgtcaccctttttcaataccgcgaaaaaggaaaaggtgcacgaaaaggcgaagaaaagaaagtgcttggtgaaaaattgaagtgggtatgccaaaaaaacgggattccttttcttgtaaatgatgacattgcacttgctttggaactggatgctgacggtgtgcatgtcgggcaggaagatgaaccgctggcatccgtacgggaaaagttgggggataagattattggcgtctcggcctatacgttggaggaagccaggcaggcagcaaacggaggcgcgaattatcttggcgttggccccatttttccgacgaaatcgaaagaagatgcgaaagcggcgaaagggacaaccgtcattcgcgaaatccgccaaaatggcatccggattccaattgtcggaattggcggcatagggccgggcaatgcaaaaagcgtcatagaagcaggggcagacggcgtttccgtcatttcttccattgcaggcgcggaagatgcggaagcggcagctgccctgttgaaaagggaactcactttataatgaaggcgtaaacccccctgcgccttttgacagtttaaaaatggaatcaagataagccgggtgtaggagcctggcttttttggtgccaagcaggctgaatggcggtgaattttttgcgagaatttttcaatatcttgattgataaaacttttgttcttgtgataaaatacaaacaaacattctgataaaataatgaagcgataaaaattttagaaacctttctgcaaaaggattgaaaacagcgaattcggaaagctgaacgggagacccgcgggattttcttaaaatgtttttcaaaatttacgcaaaggatggtaaaatttagatagcaatttggggaaggagcgaacgtgatggcggacggtgttgttgtttcggtaaatacaggcaaaccaaaggcgcttacctataaacagaaagtggtgcagagcggcatttttaaaataccgcaggagggcccggtatatctggcaaaagaaaattttgaaggggacaagcaggcggaccttgttcatcatggcggagcggataaagcagtctgcgtgtatgttggtgatcattttccagtatggggggagaaatttaaccgaacttttgagccgggggcatttggcgaaaatattacgctctcgggatgctcggaagcagatatccatatcggtgatgtttttcaaatgggggaagcgattgtgcaggtatcacagccgcgggagccttgttataaaattgctgcgaaacatggattggacagttttcctgccgacattgttgaaaccggttggtccggcttctatatgcgtgtgcttgaggaaggctttgtccggaaaaatgacagctttatcctgcttgaaaaaggggaaaaacagctttccattctgcatatcaataaaatcagataccatgatagaacaaattttgatgcgatagaagaaattttaagtgtaaaggcacttgccggcgactggcaaaaagcattccgaaaattatggatgaaaaaagggaatggataaaagaagcggcagctgtgacagctttctccaatgtaaacatacgaaggagtactgcggttccctgaaaatgaccggtacgtatgtaactgaggaagtttaatgccgttccgccatcttaactcgcagcatagatccctgtttcttcattatattatggagcagggatctaaaaaaaagatggaaaacattaccttgctctatcatattgacttaagttacgaataagtgatatgatatatgagctggcccgttagatgattaaaaaacgggtttaaaaaaagatgttgacagcgaattgatattttggtataataattgcaattagcaacttatttagtataacattacaacaagtcactgtcaacataaaatttggagcgggtgatgggaatcgaacccacgacaacagcttggaaggctgtggttttaccactaaactacacccgcatgcaaatcgggaaaacaggattcgaacctgcgaccccatggtcccaaaccatgtgctctaccaagctgagctatttcccgcatttccctggtctaaaaactatcaaaccaacttataataagaaaaggcctgttttttataaagttttcaactgcccggtaagctctggagccttttacgcagctgttaacagatcttttttgcatgaaaaaatagcgcgcccaagaggagtcgaacccctaaccttttgatccgtagtcaaacgctctatccaattgagctatgggcgcgtaaatgcggccgagaggacttgaacctccacgggatttaactcccactaggccctcaacctagcgcgtctgccattccgccacgaccgcgttattaacttgacacctttatattatatcaaaaccttttatggatgtcaactactttttatggagcggaagacgggattcgaacccgcgacccccaccttggcaaggtgatgttctaccactgaactacttccgcgatttatcaaatcaatgccggtgaagggagtcaaacccccacgccgtgcggtgccagatcctaagtctggtgcgtctgccaattccgccacacccgcggataaatggtgagccatgcaggattcgaacctgcgaccctctgattaaaagtcagatgctctaccaactgagctaatggctcaaaaatggctgggccagctggattcgaaccagcgcatgacggagtcaaagtccgttgccttaccgcttggctatggcccaatggcggttccgacgggaatcgaacccgcgatctcctgcgtgacaggcaggcgtgataaccgctacactacggaaccactcatgatatgataaatttcaaatgacccgtacgggattcgaacccgtgttaccgccgtgaaagggcggtgtcttaaccgcttgaccaacgggccgcaatgactgctttgtatgtatggcggagaaggagggatttgaaccctcgcgccgcttacgcgacctacgcccttagcaggggcgcctcttcagccacttgagtacttccccaaaatggctccgcaggtaggattcgaacctacgaccgatcggttaacagccgattgctctaccactgagctactgcggaataacaagcaacatcttgtcgactcttaacattataatgacgggacacgaaggtgtcaaccctgttttaaaatttatttttaaagcttgtttcgaagatgctgcatgcccattatttccggcccggttcagcatacgttttgtgcagcaccagttttccaccgcatctcccgcaaacgtaccggttggtgttgacctttctttgccttttatacaggatgccacactccgtacagacatattcgtaacgcggggacgggcggctgatcatgcgggaagctgctttactcggcagcacggcacaatagcggggcgcgtccgtttcctttaacaattgtttgaagtccgcatcccggtgcctgtaccctttcccttccagatgaagatggtaatggcaaagttcgtgtttgataatgccgatcagctctttttctccgagttcttctaaatattttttattgatttcgatattgtggctttttaacaaatatcttcccccggtggtccgcagccggggattaaatgaggctgcatgccggaaaggtttgtgaaaatactccattgatattttttccacaaggccttgcaattccttgttatccatggccgtatgcctccttactcataatgaaaaatggatgccgcgggcacctgcgcttttcttttcacatgacaagttattatagcatatactttagtaaaagtgcggggggattggttttgtttcagcattcaggaacaagggggcgtttgtgtgccggtatggtttcaaaaccaaatacggagagctttttgcgagaaaaggcgcagtgaaattaaactgctgaatgaatgctggtttttttacaatgaaaagaagatgcgcgtgtaactggcgcatcttcttttcacttttaatcatttggaagcatggtgagcgataatcttcctttttggacgtccactttctccacccatacggtaacaatatcgccgactgagacgatatcaagcggatgtttaacaaaacctttacttaattttgaaatatggacaagcccgtcttctttcacgccgacatcgacaaacgccccgaaatcgacgacattccggacgattccttgcatctccatccccggtttcagatcttccagtttcataatatcctttttcaaaagcggttttggcagttcatcacgcgggtcgcggcccggttttttcaaggcttcgaaaatatcttgcagggtcagttcgccgatgccgagtgtctttgccatttccgggacagacagtgtttcgagcgattggatcagcttttctgtaccgatatccgctgtcgtcatgcccagttcattcagcaaagatctggccgcatcgtagctttccgggtggatcggtgttttatcaagtggttcttccccatccggtatgcggagaaagccgatactttgttcgtatgtttttgcgccgaggcggggaatctttttcaattcggcccggtttttaaatttgccgttctcatcgcggaattttacaatattgcccgctacagtgctgctgagcccggacacatattgcaaaagagacggggatgcggtattgacatcgacaccgacctggttgacggctgtttcaacgacgaaagtgagcgattcattcagtttcttttgcgaaacgtcatgctggtactgcccgacaccgaccgatttcggatcgattttcacaagctctgccagcgggtcctggagcctgcgggcgatggagacggcgctccgttcttcaacatgcaaatccggaaattctttgcgggcaaggtcggatgcagagtagacgcttgcccccgcttcattgacgatcacataggaaacatcttcttctatttcttttaaaataccggcaatccattgctcggtttcctgtgaggctgtgccgtttccgatcgcaatgacctccaccttaaaatcccggatgatgctttttacaatcgctttggcttcttctgttttcggttttggcggatgcgggtaaatcacgccgattttcagcactttgcccgtttcatccacgactgcgagtttgcagccggtccggtacgccgggtcaaccccgagcaccgtttttccttttaaaggcggctgaagaagcaggttccttaaattctcggcaaaaatatggatagcccggtcttccgctttttcggacagttcgttgcggatttccctttcaatggcgggctcaattagccgtttatagccatcttccaccgcttccttgacgatgcctgatgtaatggaggcttcattccggatcacttgccggttcaaatacgccaaaatccgctcggtgtcggcctcaatggatacgcgcaaaatgttttctttttcgccgcggttaagcgcaagcacgcggtggggaacgattttgcagaccggttcttcgtaggcgtaatacatttcgtatacctttttctcatctttttccgcgtctttgacggtacttgccatcacgcctgttttaaacgtttgaccacggatccagccgcggtatttcggctcgtccgaaaccatttcggcaattatatcttttgcaccctgcaatgcttcttcggcagatgccacctgcttttccgctgatacgtacgctgccagttcagcatccaggtcgccttcagccggaaacgaaagcatccagcgggccagcggttccagccctttttcctttgcaatcgtggcccttgtccggcgtttttgtttatacgggcggtagaggtcttctaccagctgaagcttttctgcctgtaaaattttccctttcagctcttctgttaattttccttgctcatcgatcaggcggatgacttcctcttttcgctgctcaagattttgcaaatagttccaccgctccataatgtcacggatctgcacttcatcgagcgcaccggtcatttctttccggtaacgggcaataaaaggaacggtattgccgtcttccagcaaaccgatgacattccggatgctcttttccgggaactgcaattcttttcccagctggctgataagccttgcctgtttttcttccaaattaaacaccacacttctgattactcttctgttattttatcatgctttacgggctgaaaaaaattgcaaaataaaaaagcttgcctttactgcaagctcccaataataaatgtagcgtcgtcatccatggtctgttgttcttttaactggtcggcaatccgttcgatagactcacatttcttcaaaaaagattggacattccgctctttcacgccgtctgaatggatgacgaacctggaacccggttcatagtcaaaaatctcggttttgaattgctgcggcttgccggacaagtacccggtaatcgggatcggataagtcagtttgccgcccggtgccaccataaaaaagcggatgttgccgacacagctgtaaacaaattggcgtgatttaaaacaggctttgaaaatggcaaccgctgcgccccgcttccggtacaaagcacgattgcatgcgtccatcagcgtgtcaacatcgtcatccgattgttctttcacgactttcgcaacagcctgggaagagtagtaggcaaattccccgctccccagcccgtctgccagcacacagaggaaatagtcatccgttgccttcataaaataggcgtctccgcacaggtcccggccggcctttgttgtctgaaatccatatacttctacttgctttgaactaagataattcataatggctaattctccacatgttgcagttcaccttctatggcgtcccgcagttttttgatcgcacggcgttgcaggcgcgagacgtgcatttgcgaaatccccaatttctcacctgtgtccttctggcttaaattttcaatatacgtgtagtggatgacctggcgttccctctcgctcagtacgtgcaacactttttcaagcacaagccgctggttgactttttcatatccgtcatcttcactgccaaccatatccagcagggtcacggtactgccgtctgaatccgactcaatcgaatggtcaacggaaagtgcgtggtagcttttgctcatttccattgcttccagcacttcttcttctgagatttcaagatgtgcagcaatttcagcgatttttggcgagcgttgcagttcgttcgtcagtttttcaacagtggatttaatccgcgggccgagttctttaatccttcgggggacgtggacactccatgttttgtctctcaaaaaccgcttaatttctccgatgatggtcggaatcgcaaaggattcaaaactttttccaatattcgggtcaaagcgctgaatggcgccgagcaggccgataatccccacctggaaaatgtcctcctggtaggcccttcctttcgaatatttgcgggcaagcgactccacaagtttctgatagtgcgcgacaagtatttcctgcgcctctttgtcgccgttttgctgataagattgtatcaattgattgacatcaatctgatcaggttgaggcagttttgacattcgtctccacctgctccccttgaaggtacttggtcatcatgactgtaattccgccatcataatgtatgcggacttcatccattaaactttcaatgagataaaggcccaatcctccttctctcataaattcgatctgcacatcttccgtgtaaggccctgcgagttcccttactttttccagatcaaaactgtctcctttatcggaaaccattacttcaaggtggtccggatagaggctgaaatcgatggtgacttccccgtcctccttgtccttataggcatgctggacagcattggtaatggcttcgctcgcggcgatcttcaaatcctcgatgagttcgtaatcaaaccccatgcggcttgcaataccggaaatggtgaggcggatgactccgacatattccgctttggcagggattttcatactgatatgatcaaactcctccatgtctcacactccaccttctatttcggtattaatcttcatgatgtcggaaaggcctgtaatatcaaacagccgtttcaaacggtcggaaagccccgtcaacgtgagcatcccgccgtttgcccgcaagcttttgaacaaaccgaccagtacgcccagcccggtgctgtccatgtaagaaacattggttaaatctattaaaacttccaaacctgcttttccttcatatggttcaaatgcttctcttaattttggagctgtaaatgcgtcaatttcccccgaaatggttacgtttaaggcattctgtttttcctttacatctacttcaaagtccatttctttcacctctttaacattcatcactaagtggttcataccctttccgggctgatgacaaacctccttttaaggcagttctttttaaaatcagcaaggtaaaatcatcccgcagttcaaattcctgccatctttccagctccctgtacacattttccacgatttcctgtgcgctcttgcggatatttttccggatcaagccggtaatcgtttcccggctgacaaatccttcctttgtccggcattccgttacgccgtctgacaacagcacaatcatatcgccaagctgcacatcttttatatattcatggtacttcgattttttttctatgcctaaaaggagcccttttgcgattaaatcctcaaattcatccgtttccgcatgatagaaaaaaccgggctcgtgcccggcggatgcgtaggagaacttatgtactaccgggtcatacataccgtaaaacatcgtaataaacatactcgggtcgacattctgttcaacgacgcggttcagattttccaaaataatatggggctggtggctgtattccggcaaactgtctatcgcatatttgatcatcgacatgcagagcgccgccgggatccctttcccgatcacatccgcgatcgcgatgccgatgcggcggttctcatcttcaataaaatgataataatcgccgctcatttgtttggccggcatgctgatcacgccaatatcgatgccgtcctgctccgggacatccgccttaagcagggtttgctgcatgcccgcagcaatctcgatttcactcttcagttctttttgttttgtccggaggctttgctgttccctgtaaacgagcccgtaggcaagcatgacttccagcaggacatcaaaggactgctgcaccgttttggaaagcccgggttcgatttgctgcaaaacagagcgatggcacataatcatgtcttcaggagagatccggttttcaatcagtttgcggctgaacttctcgcactggtacagcgcctgttcatccggatgctgtagaaaatggctaagaatttctttatactcctgctccatggcatcgcggaaatccatctttttccctcctatcatcgtatccatttgattgcggtaacggttgttccctcattcggcgccgaaacgatatcaaattcatccatcaggcgccttacgcccggcaggcctgccccaagccctccggatgtggagtagccgtcttccatcactttccggatgttttcaatccccggccctttatctgtagcgatcactttcagcccctttttcccgttttgcagaactttctcaatccggatttccccttgtcctgcgtatataaaaatattgcgggcgagttcgctgatggccgttgtgattcttgcctggtcgacagcaccgaaatggagctctcttgcaatgtttctcccaagctggcgggcggccacaatatcccactcattcaaaatttttacacaggaatggttatccatacagctagtcccccaattcctgttttaatttctcaaggccgctttccaaatccagtgccgtcatgacgccctccatcgtaatccccaactcgatcagggtaatggcgactgcaggctggattccggtgatgaccacttttgcgcccagcattttggacatattgaccacatcgcccagcacttttgcgatgaatgagtcaataaaatcaatagaggtgatgtcgatgacaacaccgcttgcattcgtttcgtatattttttgaagcaaatcttcctgaaactccaaagctgtctggtcatcaagctcccattggatcgagaccagcaggcagtttcccagctttaaaatgggtatgcgcatcaatcaaccctcccattccacaattttcctccctgtcatttcaagagcctgttcaattcctctttgcagtgtactcgttgttgtaatatggtttaatttgatccccaaatttgttaacgtatgtgcaatttcagcgcggatgccaacaagcatgcagcgggagccgacaagccggacagcatttgccgcctgaatgagatgatgggcaacaaccgtatcgacaaccggcacgcccgtaatgtcgatcagcaccacctccgacttgtttttcacaatgccgtacagcaggttttccataatctgtcttgccctttccgagtcaatggtgccgactaatggaaggacggcaattttgtcaaacaccggaatcaagggggcggacaattcctttaacgcactttgctgaagcgaaatggttttttcccaaatggtggtataagcattgacaaattcattttggacggcattggtccattcccgaaagatttcccagaattcctggtgcttttcaaacacgacatccgggttgttattcatcatcaggttgtaaacaatatccccgagaatttgaatgccagtcgttgcaaaagtgagcggccagcccagcgtcacgattctttcggaaaactcgccgagctgtttctcatattcgtgattgcttttcgtcagccgcgcaagaatcacttcgacaaaatcccggcttgttttttcaaacaccaccccttcatcaaaatgaaacggggcaccgccttttgctttcatgcttttcatccattcatccagtatttcatctttatgttctggtataaatttcgctaaatatgattgcatgatcaaccctctttcctccgaacagtttgaagcgcccttctttgacagcctgctttagacatgccgggcttttccggaagacttgcacaaaaacaaatgaactgctgcctttcgccccggcggatggcttttttctgaaccggtttgttgaaaaaacacagaaaaatccatttgatttataagttattatatctgtttttgccggcaaccggaaaatattttttatgtaaatggcacagaaatcgggcaaaagcagcatttttccggaaattttcttcggtttatcttatagcgttatcatatacccgttttcagatagggttaaaccacattcgttgtattttttttgaaggtgggtttcgcatgtttgaccgcagcacgtgaaaaaatatgctaaaacgggcgacgggatgatctctcttttgttccagcttattttaagaatggcaaagcctgccgaatgaaaaaacgccctttaaaaagagcgttcctaaaattcgaccagtcccaggctgatttgcagggcgtcgtcaattttttccatgacttcttcatcaagatgcgtaatcttatccgttaagcgttgtttatcgattgtgcgtatttgttcaagcaatatcacagaatccctttccaaaccgtaacgctttgcatcaatttccacatgcgtgggcaattttgctttctggatttgcgctgttatcgcggcaacaatgacagtggggctaaaacggtttccaatgtcgttttgtaaaatgaggacaggacgtacgcctccctgctcggagccgaccaccggagatagatcggcgaagtacacgtctccacgcttaacaatcaaaggattaccccccgcttactaggctttcaactgtatgttctgcttcgtattcagcctggatcgcttcggaggcaatcgccaaattaatttttgccatttccatgtaaccacgcctcatcgtttcgcggatttggcgttttttccgttcttttaaatacatttttgtggcacggtaaattaattcattgcgattcatattttcagtttcagcaaatccgtccaattccgtcaacagctgctgcggcaagcggactaaaatttctgttgaaataggttcagacacctgctacacctccacgcactagacaccgtttctactttccattcccttttcatcataccatcaaatacactatatgcaaaggccaaatcaccattcctgtctattatcggcaaaaaaatcatgtcattattcaaaattcgccaaaacatttttcaaccttcaaggaccggattcgacacgtccgcgacatcgttcccgtttttcaggaaaatgcgcggcacccggcttgaaatggaacaggtaacctcgtagttgatggtttcgagcttttcggcaatttcgtcaacaggaatggacaaatctccctgctttccaatcaaggttgcttttgtcccgacagcaaccggacgggcaagcttgaccatgcattgatccatgcaaatcctgccgacaataggcgctctttccccgtcaatgatcacttcctgacctgaaagcctgcggatccagccatctgcatatccaatcggcagcgtggcgatccattcatcgccggaagcctgataagtggcaccataactcaccgtgtccccggcatggatttgtttcacatgcgtcaccttcgtatgaagggagaacgcctcttttaacggaaacggcaaaaccggcttgatggcgggcgaaggggagagcccgtacattgcaatgccgaaacggacagcattaaacggagactggtcaaatctcaaagcggcggcgctgtttgcgcagtgcacatacggcgggcggtgttcgaggtttaaaaccatatcctgaaactggctatattgcttttcatacaaagtcgtatcgatttcatccgctgtcgcaaagtgggtaaagatcccttcaaaatagaaacaggattgttggttcacgattttttccacttcttttaattcctgtagggttcttacgccaatccggcccattccggtatcacatttaagatggacggatagtttccgcccggttaaataccggcctgcttcctcaagccagtctttttgaaaaacagtcagggagatgttttcttcagccgcgactccggcatcttccggacgggctgcccccaaaacaagtatcggagcggtaatccctttttttcgtaacgcgagcgcctcgtccaaaaatgcaaccgcaagcgctgaagctccggatgcaagcgcggttttcgccacatattccgcgccgtgcccgtaggcgttcgcttttacaaccgcaatgatttgcgtatgctcgggcaaaagctggcgcatatttccgacattttccgaaatggcatccaaatcgacttccacccatgtatcccggtaaaaagccatgattacacttcctttatgattccatatcctgattatcgaacgcgtagccagcgttgtcaatggtttttaaaaggaagtcttatcaaaccggtttgggacggattgccgaaagcaacatgctgtaaccgcatcaagaaaaaaacccgcagagaatggctgcgggcttgtgcttttagtgcttacgaacgggttatccgcattttatttttccggttctcctccgacagactgggcgacttccatcatttccgcagccgtgagcgatttggaggcaagcgtatattcgacaccgttcaccgtccaggacagggagtcgcctgtcttgatcccgaacgcaaacccgagatccgccatttccccgtttgcaggaatcggttctgtggaagcagcagggagtacctctgccttttcctcaatcagcgtatacgttttatcgcccgtataggtcaaaataacgcgcttgccgtttgcaacggcaacttcctgttcatcgagcagcgtcgtccccccgatttttgccgtcggatattttaccgaaaactctttgttgccgacctttccgtccaccggcacttcgagtttcgcccctgtcatattttttttcgtgtcaaacgcgttgctgtcgaattttgcattaaaatccactttcgtaaaaagcacactgacaagcgtattgcggtccgtgtccatcactttcacactgactggtgcaagcgtccttttgtcaaaagtaatttgctggtacggcagcatcttatggttttgatagcgtgtcttcgtctcaaacacatatcggttctttttcaccgtcatctttgcctctttatctttcaatatgtctttcacaagtgattcataaaggtacgcctggcttgtgttgttcggccagtcgctttgaaatttgtagcttttgttgagggcgggcgtgaccacaaacacgccttctttattgcgcaaaatcatctggctctgcccctcgcccgcatttttcaggttgacacggtaatatcccggccggttgtgccaaacttcaatattgtatgtccgcggttcattgcccgttttcagcgtcattttcgcattcagcttgtagccgtccatcttctccactttttcatttaattttccggccacatcctgcggttttttcgctccgcaggcggaaagcagaaaaatggcaaacagcgccgcaaacaaaacccagtactttctcttcatcctttcaacccctttattgtctcaaatcttatgaagagaaaggcttcatcaaaagcccgtgccttgtctctcctctcttactctgaatatatgagacaacccgggcctgtatgatggggaattgaaaaaacgttatagcttcagtcttccagaatcacttgggcgaatgcatattcacggctgtgcgtgatcgacaaatgggcatggggctctgccggctttgaaaaatacgggcggccattttcatcttttgcgatttcaatttcctgaaaagacaacgcgcccccgatccccgtgccaaaagctttggaataagcttctttcgccgcaaacctgccggccaggaattcaattttccttttttctgtcaacttgcagaacttttgctgctccgcttttgttaaaatccgccccggaaaccgcggctgccgttcatacagcttttttatcctttcaagctcgacaatatcaatgccaattcctttgatcatgtgctcaccttctgtttttccagagtataaaccacaaaatttccgatacccgattttcacgctgctgcggtgcctctgccttccgtgaaaatatgcgccggtaaatcgttctgctggtatccatgatggcggttcggccctttttgaaaatacgcgccggatttgggctatccctttttccatcctgctggcggttgcggttagaagcaggccggacgtctaattcgtcatttccggcatatgtataaatagagcttttccattgaaaggagtatttgcaatgctgatccgcccgatccgcttttctgcttttattggttcctatcccgtcgtatctgccattttcctggcccagtgcctcttgtttgcggccatgcggcttccggttttaccaacacaaaccctttatgaaacactgtccggtgtgaacctttatattgcccaaggggaaatatggcggcttgtctcccctgtttttgtccatattgatttcagccacctgctgttgaattccttctcccttttgctgctcggcccctgtctcgaacggctggccggaaaatggaagtttaccctattatattttggctgcggatgctgcgccaatctcgcttctttttttctgcttccgcttacctattcccatgccggtgcgagcggtgccctgttcggcctgatcggcgcatatgtcgcccttgtctgggtcggggaagatgtgccaaaaacaagccggcaaaccattttatcgattgcggtcatttccgttgtaacggctatgatgcagcctggtgccaaccacacagcccatctttccggactcgttgccggcatgctgctcggaggcatgcttttgcaaagaaaagcggcttctcctgcttagaaaaagtcaattctccggactcattgccggcgtgctgctcgggggaatgacttttacgaaaaaaaacggattcttccgctttaaaaaaagccaattcttttcagccgcattaccggcgtgctgctcgggggaaaggcttttacgaaaaaaagcggattcttccgctttaaaaaaagcaacgggagctgccgttgcttttttaatggggcgccggcaacttttgccataccggcatttttacttgtaaagagtcgcagccggatacaaaccgacccgctcgtaaagctgatgatgctctatttttttggccccgccttcgtttggttaaaatggtttgcggtttgttgttgttcttctcggctttcttcccttattgtaagaccctttgtaggaccctgcaggcttgccccgtctgctatggtcttttttatgcggaagcggccgttcttctgaaatatgaaccggtgttttatccggctctttcgtcatcagtttcaaagcagctgccgtgacctcagccgggtcatattctgcaagcagctccttcgctaccgacatatattcatcaatattgccttctttgatggtttccccgatccgttccatggtgacgcgctgctgcccttcaaacgcttcatcccaggtcggcgggcgcatcgggagcattctctttttcgttgtctgttcaaccgttttgagatagcccatttcccgcggcgtgacaaaggtcattgccatgccttcccgtccggcacggcccgttcttccgatccggtgcacataggattccggatcctgcggaatatcgtaattgtaaacatgggttacacccgagatatccagcccgcgtgcggcaacatcggtggcaacaagcacatcaattttcccgtctttaaacttccggagtaccgataagcgtttcgcctggctcaaatcaccgtggataccttctgcaagatagccgcgcaagttcagggcattcgccagttcatcaactctccgcttcgtgcgcccaaacacaatcgcaaggtccggagactgtacatccaaaagccttgacaatacatcgaatttttcgcgttcctggactttgacgtagtattgttcaatagacggaacggtcatttcttttgctttcacacggacaagttccgggttgttcatgaagcgttcggcaattttccggatcggatccggcatggttgccgagaacagcatcgtttggcggtctttcggcacggtagaaagaatggcttcaatgtcatcaataaagcccatattcaacatttcatccgcttcgtcaagcacaagcgtatgcacatggtcgagtttcaaggttccccggtgtatatggtcaagaatccgtcccggtgttccgacaataatttgcggatggttcttcagcgcacggatctgacgcgaaatatcctggccgccataaacagccagcacatgaacgcgcgaatcctggccgatccggtacaattcttcagatacctgaatggcaagctcgcgggttggcgcgataatgattccttgaatattacggcttctatgatcaatcttttcaattaacggtatgccaaatgctgcagtttttcccgtacctgtctgcgcctggccgataatatccttcccttgcatggtgagcggaatggtggctgcctgaatcggcgatgcctcttcaaatcccattcttttcacagcttttaaaatcgccgggcttaaatttaattctgaaaacttcgtcaatcttctcaatctccttctaaacgttcaacagggccgcatgtcttccttagggttttacccttttcggcaaaaaaatatactcttttgagcattgtcagctaaaagcgtaaacgatgtacggtaatcgtaacatgaatacggcaagatttcaacgaatatggagccgtggttttttcacaatcattttgggactttcaatttttcggtaccaatggtcgccgctatacaatttttctaaaagatatctaatctttggcacaaaaaagtgataaaatcgccatcatttatatctccgggtatttcattatccagttctagaataaatttgccaaccatcactttctctttatacactaatttccctgtaaaaatataggaaaaatattcatcctccagtttttcaattgtgtactttggcctttccgccttcatcagatcagaaacattcaaacagtaaatcgggttctttaatacatagccttctgtgtaatttaacggttgggcaaagcatctgatttcggtttctccatccgtcacgattacttcagcttctaaagcttctttggaaatccactctataatttttattttcaatttagcacatcctttctatttattttaaaccatatgcttggtgctttctttgctcgttctttgtatcggtaatattttactcgaaggagcaaatgagcgaaaaaataaagggacataggcttcaaatttttaaaccgctgaaacaaaaaaatgatcattttcaattcccgtgcctgcttttccatccatcattcgatcaaacccttttagaagccatggacagaaaagcaatccatggaagaataatggcgcacttttaacccatcgactctgtttatgcactttcatcgtttgggttcatttttttcatttatggcatccattttgcttttattagttgtacaggctatggtttctgaatacaaatatatcaatcgcatgatggaaaggctgaggaaaatgatggaaagcatgattagttatatttttcttgggctgtcgcttgctgcgccgatcgggccggtgaatgccgctcaaattgacaaggggattaaaaatggctttctccactcatggctgctcggaatcggtgccatggcagcggacggtttgtatatgctgctcgtttatctcggtgtcgtccatttgctcagcatcggatttgtaaaatcattcctttggtttttcggatgctttgtccttacatacaccggcattgaaagcatgattgcagccaatcagccgatttccggtttgatgagaaacaaagaaaaattgtccaaatcattcctgaccggttttctgatgtctctgaccaatccgctcaccattttattctggctcggcgtttacggttccgtgcttgcaaaaacagctgaatctgtaggcccgcagcagtttctcctctacagcctggccatctttatcggagtggcgctgtgggatttttcgatggctgccgtctcaagcagcttcggaaaactgctaaccaaccgtttgattcttttcatttcgaggctgtccggcctgtctcttgtcggtttcggcatttatttcggcattcaggcggtcaagagtctgtagcataagcaaacaaaagtcccgccgaactcttgtaccttttcgctggttttccggaaaaaatcagcacgttcttgctttccgcccgcttttttaccgtccggccctttttgccgattcagtcacctttttttcaaataaagggatgatttctgaagtgggcatggaatcctttcatttataccgcgtttttcgaaatgcgccggatttttccggcttttcgccagttctttcgctttttctgaatctttttcgccttttctgctggtttcgacaagcaacttatatagttccatagttttcaagagaaatttcccgtatactaatcataacagcaatcaaactttataagttggaggagaattgtcaatggcagcttcacatattcaagccgttctctttgatttagacggggtcatcacagatactgcggaataccactacttagcatggaaaaagctggctgatgagctgcaggttccttttgaccgccattttaatgaagcgcttaaagggctcagccgcatggactctttaaagaaaatattggagaacgcccggccggagccttccttttctaaagaaaagctgagcgagctcgcggacaggaaaaatgaatattacaaagaactgatccgccaaatttcccctgccgatttgcttccgggcatccacaacctgctcgaagatataaaggaaaggggaatcaaaacagcgctggcttccgcgagcaaaaacgccatgtttgtcatcgacagactgggggtggcttccttttttgatgaaatcgtggacgctgcccgcattcagcacggcaagccggatccggaaatctttttaaccggcgcccgcaagctggacgcggatccggcattttgcatcggcattgaagacgcggaagccggcatccaggccattaaagcggccggcatgtttgcagtcggggtcggcacgccggaaaacatgaagcaggcggatttccttgttgaagggacgcaggatcttgactttgaaaaaatcgaaagcgcatttcttctgaaaaataaaggatgaggcgtgatggttaccatttccgatgtcgcaaaacaggcgaatgtttcaaagatgacggtttcacgggtccttaaccaccccgaacaggttagagatgatttaaaaaaactggtatatgaggcgatggagcagttgaactatgtacccaattatgcggcacgtgccctcgtctccaaccgtacccaggtcatcaagttcctgatattggaagaaatggacacaacagagccgtattatatgaacttgctggccggcattgccagggagctcgaccaaaaccactactcgcttcagctggtcacacggaaatcgaaggacatcggccagtgcgacggtgtgattgcgacgggtgtccgcagccaggattacgataccattttaaaagaattttccaaaccggtgattttattcgggcaaaatgacagagggtttgattttattgatgtggacaatgaaaaaggcgtacggctgttaacagagcatgtcattcgccgcgggtttaaaaaaatttattttttcggcattgacctgcaagagccctttatgtttgcgagacaaaaaggttatctggatgcaaccgaagcaaacgggttgccgccgtttctttgcagggtcaaaaacagttcaagcgccgcccagcaagaagcggaaaaaattttatccagccggaaggaaagatgcgcgtttgtatgcgcaagcgaccggattgccctcggtgtgatcagagccgcccaatcgctgcggctatccataccaagtgaggttgcggtcaccggttttgacggggtgtttcttgaccggatttccgctccccatattacaaccgtgcgccagcccgttgtaaaaatgggagaagcatgtgcacgcatgctgttgaaaaaaattcaggaaaacgggaaatcccaagggcaccagttttttgaaccggaagtggtcatccgcccctccaccgtctgtgaataagcagccttacaccggttgcttatttttttcaggatgggcttgggccaatcaaacccgtaaaaagcattttgttaacggtaacatcgctgaaaaatttgttccggataaaggggtgatgatacgttgaaagggtatagaagaaacgtggaggtgaaccgctttgcaagatgcgtggtggaaagaagctgtcatctatcaggtatatccgcgcagtttcaaagatgcaaacggggacggcgtgggcgatatcccgggcatcattgaaaagctggattatatccgtgatctcggggcaacggccatctggctcaatccgattttcgcatcgccgcatgtggacaatggctatgatgtcagcaactacgaaaaaatcgacccggttttcggcacgatggaagatgtggaacacctgatcaaggaagcgaaaaaacgcgggcttaaaatcattctggacctcgtgctgaaccatacgtcagaccgccacccgtggttccaagaagcgcggaaaagcaaagaaaatccgtacagggattactacatttggcatgaccctgtcaaagggcgtgaaccgacgaactgggcgagctttttcggcggcagcacatggacattggatcaacaaaccgggcaatattattttcatctgttcagcgacaaaatgcccgacctgaactgggagaacaaaaaagtgcgcgaagaaatggcaaaaatcgccctattctggctggataaaggtgtggacggattccggctggatgcggtcattcacctggcaaaggacacccgttttcttcccgttaaaacaaaatcggaagaagcctttgtgcttgcagaacagtattatgccaacctgccgcgtgtccatgattatatccgtgaatttaaccgtacgattaaagcgaagcatccggaagcttttttaatcggggaaacagcttccgccgacacgaagcttgcccggctttattcaaggccggaccgcgaagaatgcgactgcatcattacctttaactacttggggtttgacacggaagcaaaaaaacccggcattccgcaaaactggcaacagggaaaatggaatttgcttgcttttaaaaaagcgatgtcccggtggcaacatgacctgtacggggaaggcttcaattcgctctactggaataatcatgatatgccgcgggcgttgtcgcgcttcggggacgaaggcaaataccggcaaaaaagcgcaaagatgcttgccactttgatgtatttgcagtgggggctgccgattttgctgcagggcgaagaaatcggcatggtgaacttgaagctcccgcggctccaagactatgaggacccaagtatcaaagggcttgccacaattgcgaaaaagaaaggctatgcggaggaagaaattttaaaaatggtgcaacagcgctctaaagatacgtcaagaggcgccatgcagtggaacaatgatcgatacggcggcttttctacatatgctccgtggctcggcatcaatgaagatacgcggaccgtgaacgtagcggcgcaggaaaaagatcccggctccgtgctgcattattaccggaagctgatcgaactgaaaaaatcaatgcctgtctttacggccggcagctgggaaatgctggctgatgaggacccggacatctacgcgtatatacggaagcatgaaggcagctgtgccatgattgtctgcaatacatcgaaaaagctgcagacctttacctgcccggagcttacccgccacagatgggcatgcctgctcaataacaacggctatcatagcaaagcggtgccaagcaaactggtgctatcgccttttgaatgctttgttttattacaggagtagcataagaggaggagaaaagatggaacacgcaggaatttttcatcagccgttcagcgctgatgcatatgtatatgacaaaaaaacgatgcacctgaagctgcgcacgaaaaaaggggatattcagaaagccgtcctcatttggggagacccgtatttatttaaaaaaaagcaagacggggaatatcactgggaatctgaacgcctcgaaatggaaaaaaaggctgaaacagaggcgcacgatgtctggtttgccgaagtccgtccgccgcaccgccgcctgcagtacgcctttatccttaccggcacggatggcagcaacattttttatggcgggcgcggcttttacccggcaaatgaagatacactgcgggtgcctgactattattttaaatttccgtttatgcacgaaatcgatatgttcaaggcgcctgactgggtgaagtccaccatttggtaccagattttccctgaacggtttgcaaacggcaatcccgccatttctccggaaaatgccctgccgtggggaagcaaagacccgggcgtggacgactttttcggcggcgacctcgaggggatcatcggccatctcgattatctcaccgatctaggcattaacgggatttacttgacgccgattttcgaagccccttccaatcataaatacgatacattcgactattttacgattgacccgcatttcggcgataaagaaacattccgcaaactggtgaaagaagcccacaagcgcgggatccggattatgctcgatgcggtgttcaaccatattgggaaaaattcaaaacagtggcaggatgtgctgaaaaacggggagaaatcgcgctacaaagactggttccatatccactctttcccggtccgcgaaggcgaaaacgggaacattgacgggcatgatacgctctcatttgacacgtttgcttttacgacaagcatgccgaagttgaatacggccaatcccgaagtccaacagcatttgctcgatattgcgacatactggatccgtgaatttgacattgacggctggcgccttgatgtcgccaacgaagtcgaccatgctttttggaaaaagttccaccagaccgttgtaagcgagaaaccggatgtttttattctcggcgaaatttggcatgatgcatggccttggcttttaggcgatgagtttcattcggtcatgaattatccatttacgcagacgataattgaatactttgtggatgaaaacatttccgctgaaaaactgatgcacagcctcaaccagcagtttatgcactatatgcagtccaacaacgaggttttgtttaatatgcttgacagccatgacaccccgcggattttgacaaaagcgggcggtgacaagcaaaaggtgaagcttgcccttgcctttacgttcgcgcataccggttcgccgtgcatttattacggcaccgaggtcggaatagacggcgcaggtgacccgctttgccggaaatgcatggtctgggatgaagacaagcaggatcgcgacatgctcgcatttatgaaaaagctgatccgcttccggaaagaccatcaacaaaccttgacatacggcgatctcgtctggctgaaaaccgataacgaaaaacaagtggtcagcttcctgcgcaaaggggaaaaatgcaccttgctgtttgcctttaaccggtcggaccaagaacagaccatcccgtggagcgagctggatgtaaaaccggacaccgtaaaagacgcttgggaaaacaaaccggtttcaagcaaaacccttgtcctcccgccaatggactttgcgattctggaaatcacaaactgaccctgaccgtagcgttcttgaaacccattcgtcgcttcccattgcgattttaaaaatcacaaactacccctcccccctgccggataattggcagggggcttttcattttgttaccgttaacagaaaattttacattgtaaccgttttccactctcttctataataaagttgtaccaaaaaagggaggttcatgaaatgaaagtattcaagaagctgttcgtgcttacgcttgtcttgggcgtcatcatggcgctcgccgcgtgcgggggatcgaaaaaaacaaacagcggatcttctcaagacagcggtgacaaaaagacgctcacggtttccgtggaagaatcttatgccgattatgtcaacagtattaagggcgattttgaaaagaaaaacaattgtactgtaaaagtggtcaaaaagccgatgtttgaccagctggaagcactgcctttggacggcccggcaggaaaagccccagatgtgatgctcgcttcttatgaccggatcggcggactcggccagcaggggcatctgcttaaactgtccaaaaaagatgttagcgcctatgatgcaaaagaccagcgccaagtcatgatcgacaacaaagtttacggcgtcccgttcgtcattgaaacgctcgtcctttattacaacaaagatttgttgaaaagcccgccaaaaacatttgccgatcttgaaaaattggcgaaagacagcaaatataatttttcatccgaatccggaaagaatacaggattccttgttaaatggacggacttctactattcttacggcttgctcgcgggtgacggtggctatgtgttcggcgataacggcacaaacacaaaagatatcgggttgaacaatgccggttccgtaaaagccattacgtacgccacacactggtttaaagatatttggccaaaaggaatgaaagatacaaaaagctccggcgactttgtaacagaagaattctcaaaaggcaaagcggctgccgtcattgacggtccttggtcggcggacacctacgcgaaagcaaaagtaaattacggcgtagccccgatcccgacgcttccaaacggccacaagtacgaagcattcggcggcggaaaaggatgggttgcttccaactatacgaaagaaccgaaacttgcggaaaaatggattcaatacgtcaccaactccgcaaacagctacaaattctatgaaaaatacaaagaaatccctgccaacccgactgcgcgcgaaaaagcggctgcgacaaatgatgaactgacaaaagcggttgttgaacagtacaaatccgaccagccgatgccgaacgttccggaaatggcagaagtctggaccggtatggaatcgacgatgtttgacgcagcgagcggcaagaaaacaccaaagcaggcagccgatgcagcggtgaagacgatcaaagacaatatttcccaaaagtattccaataaataatccgctttatccatttccaggtggggatacgctccacctggttttcaaaatatggtgctaggccgttagcaggttgaaagccgtgtaaacttccaggtttggcgtccatgttgcaaaaagcaccagtaacataagtcaactgcgcgtattttcaagattggcatccggaccacaaaaatctgctgccaacaaaaaatgaaatattttcaaaaaggtgtccctgccgcaaaactgcagcgctgtatcacatggacgtaagaccaagtcatccatttgcaaaaggcacaaagtagccatgtttcgctcattttctatagctgcagcatgaaaatctgccagcgggattttttggaaagaccaatatagaaacgaggtaatcaaaatggaaaccgaaccgaataaactgaaggatgtccgaaaagccggcttcttctccctgatcccggggctcggccagttttataacaagcagccttttaaaggcgtcctttttctggctatttttatcctttttgccatccaaatgatcgtagcaggcatcccggcaataaacgattttatcacgctgggttctgtcccgcgggttgaccattcgctgtttctgctgatcaagggttccctgcaaatcattttgatcgcaatttttctagctttttatttgctgaatatttatgatgcccggcgtgttgccgccatctggaacttaaaggggacagccaacacatccaccaaggccattttaaaaaacgcatgggatgcaggctttccttatttgctgacgattccggcctatgtggccatgacattcgtcatcatttttcctgtgcttgtgacgctgttcactgcttttacaaactatgatttttatcatattccgcctttccgcttgattgactgggtcgggatcaaaaatttcttaaatattttttcgcttagctcgtatcgggccacgtttacaagtgtgctcagctggacaatcatctggacattatgcgcgaccaccggccagattgtgctcggcattttaacagcctgtgtggtaaaccagccttttatcaaagggaaaaagctgtttcggatcatttttttgctgccatgggcggtgccggcctttattaccattatgagcttttccaacattttcaatgacagtatcggtgccatcaatgcccaggtcattccgctgctcaaccatcttctgtttaccgacattccggccatctcgtggaaaacggatccgttctggacaaaagtggccttgatcatgatccagacatggctcggtttcccgtatatttatgtgatggtcaccggcgttctgcagtcgatcccgggcgatttatacgaagccgccatcattgacggcgcaaatttctggcaaaagttccgcaggattaccctgccgatgattttatttgccaccgcgcctgttctgatcacccagtacacatttaattttaataacttctcaattatttatctctttaataacggcgggccgggcagtgtcggagcgggggccgggtcgagcgatattttaatttcctggatttataaactgacgaccgggacatcgccgcagtacgcgatggccgcggcgattacccttatgatttcatttattgtaattgccgtctcgatgatcgcctttaaaaagacaaacgctttcggcaatgaggagatgatgtaggatgaaggcgttaatgaaaaatcaaaaatttacccgtttctggaaccggtttttcacctatgcatttttaatcctattaagtgtgatcattctgtacccattgctcattacagcgtcgtctgctttccgggagtccaatatcgtttccttccagctggattttcattcccactggacattggacaatttccgccagctgtttacccagacgctgtatccggaatggtataaaaacacgcttatcatcgcggtagcaacgatggttttacaggtcgtcatcgtgacgcttgccggctacacttacagccgctaccgttttaaaggaagaaagtacagccttgtctttttcctgatcatccaaatggttccgacaatggcggcattgaccgcattttatgtcctggcgaatatcctcaacgcgctcgatacgtactggtttttaaccttgctttatgttggcggcggcattccgatgaatacgtggctgatgaaaggttatttcgatacggtgccacgcgatttggacgaatcggcaagaattgacggggccggccatttgcgcgtattttggcaaattgtgctgccgcttgttaaaccgatgcttgccgtccaggcactctgggcatttatggggccgttcggggattatttgctggctaaatttttgctccggacaccagaacatttaaccgtggcggtcggcctccaacaatttatttccaacccgacccagcaaaaggtgacgctctttgctgccggcgccattttagccgcgctgccaatctgtattttgtttttcttcctgcagaaaaactttgtatccgggctgacgtcggggggcacaaaaggataaagtgcgtaacgagatgaacagctttaacagctgccggcccatgcggaaaaaacttgcaaaaaaacatagaatactttattgaaatgtgggattgcttatggaacagattcaaagattccctgctggttattttgcgacgatcgtttcacccgtaaaaatcttccggcaccggggcgcgcttggcgtttggaaactgattctcatttttttctttttaaacgcctgcctgattgccccgctttcactctcttttgcgcaggcaggaaatatcagtttaaagcaagtggcgccgcatttatacgaagcagtgcaaaccggatataccgggcaaaacgccgtcctttcctttcaaaacggcatgctccaatccagcaacgcgtggacaaaggatcacggagatacgattatctcctttgacccaggcaaaaccgctgccgtttcagaaagccattaccatacaaaagtcacgcattacaaaaatgcgctccttttccggaaagaccggctcattctggctgatgaaaacggctttggcttttccgtccgctacccggccggaaacgagaagatcacgatccaaaacggccgtgaccttgcttcttttgccggcgctctctggttccggcaatataaagtcaacctgattccgcttgtttcatgcctgatcggaatcctgtttcttttcagcaatatacttttaatgggggcagtgtccctgatactttggctgacacgtttttcaagttcttccggcatccggtcattgagacaggctgcaaccattacactatctgcagcaggggttccgtccattattgccatgttggcaggctttgccggcgcaggtgctgcaacgatgatgatgatccaatcactgggcatggtgcttttcattgcgatgatttttttaaaaacaaaatttctggcggacgacatgtaaatacaagatgctgacgaggaggatttctcatgtattataaccggcttttcgatgtagatgaatggactttaaaaacaacgaagctccaccgtgaacatattcggcttcaggaaagcatcacttctttaggaaacggctatatgggaatgcgcgggaatttcgaggagtcttattccggggaccatcaccagggcacgtatattgcaggggtctggtacccggataaaacaagggtgggctggtggaaagtcggctatcccgattatttcggaaaggtcattaacgcagtcaatcttgtcgggttgcgcgtctggattgatcaagaggaaattgacctgtttctggacccgctcgaacaatttcaactggaacttgatatgaaaaatgccgtcttgcgccattcctatcttgtcgaaaagtctggcaagaaagtcaaaattgaatttgaacgttttttcagcattgtctataaagaaattgccgcgatccgaatccgtgccaccaatcttggcaatccggccgtcctcacgttaaaacctttcctggacggcaatgtcaaaaacgaagacgccaattatgatgaaatgttctggacggaaatccagtctgaagcaacggaagacaaggccgcggttgtcacggaaacaattgaaaacccgttcggtgttccccgttttaccgtagctgccgccatgggcaatctgacggaggcaacgcttgcttcctgtgagtcggatacgctttatgccggccacgtatatgaaaaaacgctcggcgaaaacgagtcgctccttctggataaaatggtttctgtcacgacaagccgggactatgaaaaggatgcgctcctcccccgcgcctacgaattgcttgaacaggctttggaaagcgggtacgaggagctgtacgaggagcacgcagcagcctggcataaacggtgggagaaagcagacgtccgcatttccggcgatccggaagcccagcaagggatccgctttaacctatttcagcttttttcgacctattacggcgatgatccgcgcttaaacatcggcccgaaaggtttcaccggcgaaaaatacggcggcgcgacgtactgggatacagaagcctatgccgtacccatgtatctggctgttgccacgccggaagtcacaagaaatttactgctctaccgctaccatcagctccccgaggcgtatgaaaatgcaaaaaaactcgggctgaaaggcgctttatacccgatggtcacttttaccggaatcgaatgccataacgaatgggaaatcacattcgaagaaattcaccggaacggcgccattgcttatgccatttacaattatgtcaattacaccggcgataaagcctacatcagccagtacgggattgatgtcctcgtgggcatcagccgctttttcgccgaccgtgtccatttttccaagcggaagcaaaaatacatgatccatggcgtgaccggcccgaacgagtatgaaaacaatgtcaacaacaactggtacacaaaccggattgccgtctggacgcttaaatacacccttgcgtcccttgattttgccggtgcggaaaaagcagccgcgctgaatgttacggatgaagaacgcgcgcattggcaggatattatcgaccggatgtattttccgtatgatgaagagctgggcatttttctacaacaggacggcttcctggataaaccgatcaaaccagttagctgcctcccgaaagaagatctgccgctcaatcagcactggtcatgggaccggattctgcgctcctgttatattaagcaggctgacgtactgcaagggttttatttcttcaatgatgcgtttacaatagaagaaaagcggcgccattttgaattttacgaaccgctcaccgtccatgaatcgagcctctccccgtgcgtccatgcgattctagcggctgagcttcgaaaagaagacaaagcggtcgaactgtataagcgcacgtcccggcttgatcttgacaactataaccatgatacggaagacgggctgcacatcacgtccatgaccggaagctggctctccattgttcacgggtttgccggcatgcgcaccttccatgaaacattgtcgtttgcgccgtttttgccgaaagactgggatgaatacgcatttaaaatcaattaccggcaccgcctccttgaagtgaaagtaaacaaaaaagaagtcaccatctcccttttggaaggcgaaccgcttgaattgaagttatacggggaattcatccatctaacaaatacgtacacgaaggagtatgagctgtcatgacagaatggtggaaaaaagccgttgtttaccagatttacccgcgtagtttttatgatacaaatggtgacgggatcggcgatttgcggggaattatggataagctcgactatttgaagaaacttgggatcgactgcatctggatcagcccggtgtacgactcgccgcaggatgacaatggctacgacatccgtgactaccgcaagatcgacaagatgttcgggacaaatgaagatatggaccgcctgcttgacgaagcccatgcacgcgggattaaaatcgtaatggatcttgtcgtgaaccatacctccgatgaacatgcctggtttgtcgaaagccggaaatcgaaggataatccgtaccgcgacttttatttttggaaagacccgaaaccggacggcacccctccgaacaactggggttcgatgttttccggttccgcctgggagtacgacgaaacaaccgggcaatactatttgcactatttttcaaagaaacagcctgacttaaactgggaaaacgaaaaagtgcggaaagagatttacgatatgatgaagttctggatggataaaggggtggacggctggcgcatggatgtgatcggctcgatttccaagttccttgattttcctgattatgaacttccggaagggcaaaaatacgacattggcaagtatcatgcaaacgggccgcgcctccatgcgttcatccaggaaatgaaccgcgaagtgctgtcgaaatacgactgcatgactgtcggggaggccattggatccgatgtcgaaatcgccaagaaatatacggggccggaccgccatgaactcaatatgatttttaactttgaacatatggatgtcgatacgaaaccaggcagccctgccggcaaatgggctctgaagccttttgacctcattgaattgaaacaaatcctttcccgctggcaatatgcgctcgcggataccggctggaatgcgctctactttgaaaaccatgaccaggcaagggttgtatcgcgctggggcaatgatacaacgtaccgggcggaatgtgcaaaagcgtttgccaccattttgcacggactgaaagggaccccttttatttaccagggggaagaaatcgggatggtgaatgccgcgcttgaactcgaagaatatgatgatattgaaatccggaatgcttatcaagaactcgtactggaaaatcaaatcatgacgaaggatgaatttttaacagctgtccgaaaaaaaggacgtgacaatgcacggacgccgatgcagtgggacagcggtccgaatgccggctttacaaccggaaaaccgtggcttaaagtgaacgcccgctatccggagatcaacgtagcaaaagcgcttcaagattcgaattcgattttttattactatcaatctctgatcaagctgcggcatacatatgatgtgtttacagacggccggtatgagctgctgatgccggaccatccgcatttgtacgtatacacgagggagaatgaatcggaaaagctgctcgttgccgccaacttaagcgaaaacacggtaagctttgatcaaccggatggcaactggaaactgctgcttggaaactatgaagatacgcgctccagcacgctgttccgcccgtatgaagcaggaatttattatctggaaaaatagatttttgtgctatgttcacccgattgcctttggatgcaaagagcgtgtttgtacggcggttgctccgccatacgcctccgctttgcccggttgcttttttatgcaaagagccctctatcctgcgtatgaggggctctttgctgtttctttggtttggtagatttttggctgaaagtctaggcacgtttctttcgcaggagatatggctggaatttgtcccgcttcttatcgcagacgcctccctacgatcacttttgaacgaaattctgaccgctttcttaacgtagatgcggcctatgtgaagaaaggccggctttttcccccgcttgcttcacttagaggtggtctatgtgaaggaagagatcctttttggctcggtttcttaatgtggacgcgctctatgttaagaaacaagctcattttcctccgcttccttaacgtagacgcgctctatgttaaggaagcacctcattttccctcgcttccttaacgtagacacgctctatgtgaaggaagcacctcattttccctcgcttccttaacgtagacgcgctctatgttaagaaactatctcattttcctccgcttccttaacgtagacacgctctatgttaagaaactatctcattttcctccgcttccttaacgtagacacgctctatgttaagaaactatctcattttccctcgcttccttaacatagacgcgctctatattaaggaagtaccccattttctatcgctttcttaacgtagacgggctctatattaaggaagcacctcattttctatcgcttccttaacgtagacgcgctctatgtgaaggaagcacctcattttccctcgcttccttaacgtagacgcgctctatgttaagaaacaagcccattttcctccgcttccttaacgtagacgcgctctaagttaagaaacaagcccattttcctccgcttccttaacgtagacgcgctctatattaagaaagcacctcattttctatcgcttccttaacgtagacgcgctctatgttaagaaactatctcatttccctcgcttccttaacgtagacgcgctctatagccaagttcccgaccgcttcccttacattgaacccgtccaatctccattccacatgacaaagcttgccggaaaatatcctttgccaaaaatgaaagacagccgccggaaaaaactggcagctgtctttcacgtatcatctatttaggaaaccgtaatggccttgaccacttcttccagctgcatgcctcttgaggctttgaccaaaaccaaatcgccggctccgatttttcctttcaacatatcgatcaaccgcttcttgtcctcaaacgcaaacacacggttgtccggaaaatcgcaagcttccgcgatcagacggcccaacttgccatatgtaaaaacaaaatcaattttttcgggattcaagtcgcggccaacctccctgtgaaacgccgcttccttttcacccagttcaagcatatccccgagcacaaggattttccggcccgttccttcaaactgctccaccaaccggatggccgcacgcatcgacgtcgggcttgcattatatgcatcgttgataatttttgaaccgttgatgccgtccgccatttccatccgcattgcgctcagcctcgttttcccaagccctgcgcggatttcctcaaatggcatgccaaactcgcggccggcaagaatggcggcaagcgaattgatgacattgtattcaccaaggaccggcagataaaaatcgatatcttccgatgcatttgtccggaacgcgctgccgcttgtctcttgtttccattccaccggataaagatcatttccgtgccctttgccaaacgtctttgttcggatgccggtaatgtttggcacccgttcctgcaaaagcggttcatcccccatatagatcagcagcccgttttccggaaggccttctgtaatttcgagttttgcatcggcaatcgcttcacgggaaccgagattttgaatatgcgcctcaccgatatttgtaataatggccacatccgggcgggcaatcgatgtgaggaaagaaatttccccttttgcactcatgcccatttccactacggcgatttccgtgtcttcatcaagggacaaaagcgttaacggaacgccctggtggttgttaaaattgccttccgttttttgcactttaaatttttcggaaaggacggaggcgaccatatcttttgttgtcgttttgccgttgctgccggtaatgccgacaacttttgcccgcaaggcgttccggtagctttttgacagttcttgcaagctcttctctgtgtcttccacgataagaagcggcacgttcgccggcgggtttggcacatctttttgccagagggatgcagctgcgcctctgcggaacgcgtcttccacatattgatggccgtccgcatgtctgccagtaagcggcacatacagattccctttttcgattttgcgcgaatcaatgcatacgccatgtacaagcgtttcgttgtgttgcagttgttccccgtcttccacatggatcattccggtcatttcccggatcgtccgtttgatcattttcgctcttttcctccttgaaaacagaacgggaaccattcagaatggttccaaactaagatttggaaagtatctcgtccgcttaaaattcagaacgggaaccattcagaatggttccaaaccccgttacaaagtatatttaatccgctgtttttccgcatgtcgctccagggcaagttcaatcagcttttcgatcagctgcgggtaatccagccctgcctctttccacagaagcggaaacatgctgaacggtgtaaatccgggcatcgtattgatttcattgatgatcacccgttcgtcttctgtcacaaaaaagtcagcacgcaccagccccgagcagtcgagtgctttaaatgctgtaatcgcagcttcggtacattttttatacactttttcgggaatatcggccggaatgattaacgccgtttccccgtcttcgtatttcgctttataatcgtaaaaatcttttttcgcgacaatttcgccggcaacggaacattgcggatcgtcattcccaatcacgccaagttcaatttccctggccgtgacgccttcttcgacaatgattttccggtcgtactgaaaggcctccttaaatgctgcttccaactccgtgcggtttttacacttactgatcccgacgcttgaaccgagattcgctggtttgacgaaacaagggtagccggtcttttcttccacttgttgaaaacaggtttcgggcgcattttcccattcactccggataaaagaaacatatttcacttggtcgagcccggcttgtgcaaacaggtttttcataattactttatccattccggctgaagaggcaagcacgccgtttccgacatacggcaggtttaacagttcaagcatgccctgtacggtgccgtcttccccgtttggcccgtgcagcagcggaaaaatgacgtcatagccgcctttttcacccgatacagtggttgacagcgcattgggggccattttctttccgtcacggaactcaagctgtttcacggtttcaacaggtccggttaaaagcggcccttttatccagtccccttccgttgtaatgaagatggggtaaatatcgtatttttcgtgatccaaggcctgtattacagctttggcggtttgcagggatacttcgtgttcagcggatttcccgccgtaaagcaaacagattttctttttcattgtcatcctccatcatacgaacaggatattcctattttaacattttacacacccggtgtgcgccaaatttgccattttgatttgttcagtttcttccctattgtatggcaaaacgggcatttgtgtaacacgatttgttcaggatttttttaaagggggctgtttcccgttgcgctttgcgacttgaaagatggtgcccgttaaaaaacgccgtcgtctgcagccctaaagatggttttactaaaaaggttttccgccgctatccattttaaaaataaaacaggacccgataccattgaaatgcgggggatcggccctgacgttgaagaggattttgcatcatgaaaagcggggtggcttccttccccgcttttctatcgtaaaacgcgccagctgcttttcactgcagcatggacgtctaatgaattaaaattttccattcctgcatcctgcggtcatagaccatttttccatcgattggcgtgccggagatggcggcatattcttcgtgcatttcatccatatcatgaaaatcgccgatcgtccaaaacgggatttcaatttgcacccgggtctgcacggcatattccatcgaaatgaccatcccttccttcatcttctccgaaagcggcaatagcacctccaccgggatagcgggcaacgctttccgctttttccgcccgaacagaaacggtttctctcctttgatcctgttgatccgctcggcaaccacatagccaagcatcgcataaaaatcacggaaagaacggaaataaattttgctgtagtagccgtcatcctgcgataaatagacgaaatggttatttaatttccggtaaaaaggcatccgcaaatgatgcttcatatggctcagatacagtagttccgcaatttcatacccctccagcagatcgagcccttcctcatcctcaaaatccacccagcaaaaatccccgtagctgtaaatgtcttcttccagcaggcgcccgatcgtttcctcatccgcatattcaaacagcgtatgtaaatttacagtgcctgcctcaaattgatgacggagaagaaggagattcgtcaaattgggaaaagcatggtaaaattcataaaaacagatgccgtgcaataaaacatagtgattcacttcattcgcgtgaacatatatgagctccctgttgccaccatggtttttcaaacgattacccccgattgtgcagaacatgttatggactaaaacctgccagttctcataattttattttaacaaatttggcaaaaaaattggatttttatttcattcctatctgaaaatcgtgcatcctttatcctcattgatgattataatgtatttccactaaatgcaaaaccatataccccctaaaccagtatgatcatttttaccgggagaagatgcgccttgtgcttgcagttctgattgaaatgattcaaaatatggataggaatatacagaaaacgacgaattactttcttgttcccgggcaagccccgttttttctcctgtttttcgggaacagtatacaggaagagtctcttaaggaggtgcatgtcttgccgaatcaggggccatgtaaaacgattcgtttttgcatctcttggcaggacaaaccatgctgacgatcaaattgcttattattgtcttattaatcggggccaatgcgttttttgtcgcctcggaattttctctcgtaagggtgcgaacatcgagaattgaccagctcattgcggaaggcaacaaaaaagccgcttccgccaaaaaagtaatctccagcctggacagctatctgtcgacaacacagctgggcatcaccgtgatttctcttgttcttgggtggctgggcgagccgacattaagggtgatttttaatccgcttttaatcaaactccatgttcccgggaccctcatccacgtggtgacctttattctttcttttctcatcatcacctttttcagcgtcgtggttggggagcttgcaccgaaaaatattgctatccagacagcagaaaatattgtgcttctcgtcgccaaaccgctgattttcatcaacaaaatcatgtatccctttacgtggacgctgaacaagtcttcgcggcttgtgacaaaagcgctcggttacgacatgcaatcggacaatgaaatcacccattcggaggaagaactgcggattatcctgtcggaaagcttaaaaagcggtgaaattaaccagtccgaatataaatatgtcaacaatatatttgaattcgataaccggatcgcaaaagaaattatggtcccccgcacagaagtagtcacggtcgacaagagtgaccggattgccgatctcatccggctggcacaatctgaaaaatatacacgctacccggttacagacggggacaaggacaatatcatcggcgtgctcaacatgaaagaagtgctgacggattatgtttcaaacccggatctcagggatgatgcgacgattgaaccgtatattaatccgattatccatgtcattgaaacggtaccgattcagggtgttcttgctcgcatgcaaaaggacaacacccatatggccgttttactggatgaatatggcgggactgccggcattattacagtcgaggacattttagaggaaatcgttggtgaaatccgggacgagtttgatacggatgaaatcccgcttatccaaaagatcggggatgcgcattatattttggacgccaaagtgctgattgaagatgtaaatgacctccttgcgatcgaaattcccgatgatgatgtggatacgatcggcggatggctgttgacacagaaatatgatttaaaaaagggcgattccgtgccgttccaatcgtatgactttaaagtaaaagatatggaaggttcgcacgtcctgtatgtggaagtatcaaaaaaacaggaagcagcttcctcctaacgggggctgcgcaacctggtttttcctgcttttgaataaattgaattttcctaattacattttatttctaaccgatacgtttgactgtatggtatttatgttttataatagtcgtaatataagtttgctttttcagagattggggtgattccaatggggctttgtaccgcatcggggaattagcatccattgccaatgtttcaaaacggaccattgattactacacccggctcgggctgttaaaaccacaacgtaccggtgcaaattaccggatttatgacgaaaacgccgtaaacgaactgcagtttatagaagaatgcaaaaaaatgcatcttccgctgaaggcgatccgggccaaactggaatgcagaaggaacggcatattgaatgcacatgccttaatccagcaattgaacctcttctccgaacagctaaaacagctcaatacggaactgaaggatataacaccgaatctggaaaaactgccagaagcgcaaaaagaaacattgcgcaatcaattatcgggagacagcctggcactcgtccagtccctttcctccattttaaacagggaagtggtttggcgctaaaatcgggaatagaatcattcaattttgtaaaaatacaggaggtgactcctgccccgtctctattcggagcagggaaacttatttggacatatttaaattggtgctgatttttatattaatcgcactttccgctttttttgtagcttcagagtttgcaatcgtaaagattagaagttcccggattgaccaactcatcgaagaaggaaacaaaaaagcgatttcggtaaaaaacatcatcacaaatcttgatgagtatttatcgacctgccaattgggcatcaccatcatttcgcttctgatcggatggatcggagaagaaaccgtatcgcatcttctcgcccccgtgttcgggctgttgcatcttccggagtcttttggcgccgttttctccgtcatccttgcctttgctgtcattacctttgtgcatgttgtggcaggagaacttgcaccaaaaacagttgcgattcaaaaagcggaaaccattacgtttcttgcagcaaagccgttaattttgttccacaggctgatgtacccgtttatttggctattgaacagttctgccggcctgattacaaaaatggttgggatggaatccgcatcccggcatgacgtcgcccatacggaagaggaattgcggtttatcctgtctgaaagctataaaaatggtgaaatcaatcaatcagagtttaaatatgtaaataaaatttttgagtttgataaccggattgcgaaagaaattatggtgccaagaaccgagattgtctccctttccaaaggtgattccctccggacgttcatggacctcgtgcaggaagaacggtttacccgctaccctgtcattgacggagataaggaccatattatcgggatcatcaatttaaaggaagtcttaaccgatgtactgaaaaaacaggctcccccttcgtcactggaagcgtatgtccggccgattatccgcgtgatcgacacgattccgattaatgagctgctcgtcatgatgcaaaaagagcgcattcacatggccgtcttgcttgatgaatacggcggcacgagcggcattgtgacggtcgaggatattttggaggaaatcgtcggtgaaatccgtgacgaatttgacatggatgaggtgccgctgatccggaaagtcaaggacggtcactttattatcgactcgaaagtactgatcagtgaagtgaatgacctgctcggcacacaaatttccgatgaagacattgataccctcggcggctggattttaaccaaaaagatcgaggcgaagcagggcgacacggttgaattcggggattacacctttacgatcagtgaaatggaagatatgcatatccgctatatcgaggtgaaaaagaaagcggcacggccggcggttcaaactgcaaaacaggaacccgtgtccatgcttcaaaatgaatccggacatcctgaaatgttaaaagcttttgagtaatggaaggcagcaaaaacctgcctcggtgcaagccaaaaccaaaaaaacgcggacgatcgcttggtcgcccgcgtttttccgctccgcaaaacaggaattaatgttttttgtaaaccggttgcaactttctcccttccagcacttcgaacaattccagccgggatttcgtaaaggaagttttaattcccatttccgaaaaggccgatatcatctttattaaatgatcatggttttttttcatacgaccacctcatctatcatgaatttccgtactgtttccttatctgtatatgtattcccatctatataggattttacacggcatttcttaaagttttatgaaaattttcttgtcttactcttaatatagcaaaaaaattaaaaaaatataagggttttcatcaaaattgtttgatttcctttcataagtctgcgagaagaacaaatagaccggttgcagctgtctcctttccgcactggacatcaacggaaatgtgtattatgctaaatagttgaattatcatctgtcacaatcgaagcagctacctgctttttgtttacatattttactaaggaagtgtgtcgtcctatggccgccttactgaatgattatgccaaaaaacttcagaaccatttgcagccggagcgcgattcccaccagaaactggtgcaaaaagggctgctgttgtaccgccagcatctagtccatgacaaacggatttcgggacggtttttgcgcgggaaagttcaggatgtgacaccggtggattgcgggctggatctttttgacccgttgttttttgattgttcctgcccccatgacggtttttgccgccacctgatggctttgtttttctctgcctatagtgaagaaaacagtgtgtttgactgggtccgggagtggaagcgacgcagtacggacggggacattctgcaatccgtgaaacgggcaagcgatttgctggagaaaaaggcggaaacatccgggcaaaacatcagcatgtggctggacgatttccataccgcttttgaagagatcaatgtgaatgatgaatttcttctcgatctctcggcaagggaagtataccgccggcttaccctttttttgcctgtcgaacgggaatgggagccgctttacaaactgactgctgcctatgaattgtttaagtacattaacacgatttgtttgaaaaatgactttttttcgtccacggctctcatgcaatttttgtccggcgaagcggaagaagcggcaaaccagctgtcgtccgcagcgctcccgtttgtttttgatccgtttatcgcttatttccgcgaaaacacccgtgagctggcagaaagtgtatccctctacgaacttgaaaccgttgatttttaccgaatcctctggtcgcgcctgctaaagaaagaaaattggcggaaagaggaagaggcgcgtttaaggaaggaaattttaaacagcattgatgccggtgaaaatctctcctccacgaaggtgctctgcttcatccatctcgcctttttgctcgggaatgacgacaccgcgctgttttttctcaggcagctggctcaaagcggcgtcaatacagccgtatatatgccgtactggttcttggaactgaaagcggacgagagactgttccgctatatctccgctgccttaccgatgatcccgcgccttttggaaacatgcggggatgactatgacaaggctgcctatatgcgaatgtttttccgctccatcaatgaacaggcgctctccgcccagcagctgaaattactggaaaaactgtaccgcgcctttttgcctgtcagcgccccgaaatacggggatattttatttttatccgcaagatacagggagtgggcggaactccagacactgatcggcaatacacccgaggatatggcaaaagaaaaactcgaacgggttgcaaagcaagcacctgaagtcctcctccctctttaccaccgggcggtcggcatctgtatcggggaaaaaaaccggaagtcctatcaaaaagccgtccgctatttgaaaaaattaaaagccatttaccggaaacgccatgaagaggaaaggtggtacgcattctttgacgaaatcaaggaacggacaaaacggatgcgcgcttttcaggaagaatgcaggaggggaaatttgaccgatgcagatggaatatgatgtaaaaatcaatatacaaccggatccgggcgggcgttatttcttatatgccgaagaccgggccggaaacgaagccgatccttcctactgggcgccgtctttgttgatgtggcatgaagaaagtttttatggcgccttcataccgtacacgcgtttcggaaaccgcagcgggattttggccgacagctttacgcttttgtccctgctcggaaaagaaggtttcagttcgatgttgcgatgggattgggatgaacgcgggcaaatttatcttgctgtggctcccgtgctgcttgatgccgttttaagcggcggctggcttgcgacagcggctgcacttccggaagaagaagcatgggcgatagagctgcctgataccgtcatccacgagttcaacccgtcattttgggaccgggagctggatgaaaaacctttgtcgcgcgtgctctccgaatggtacggagaagcggcccgttcttttatcgccagccggccgcaattgaagcggcaattcatggagctgaaaaaatcaggctttacaaaccaggaactcacctcctattttgacaagcgacgctttcaactatgggcgggcgaagcgtccctcccctttacaattgggatccgcctttttgaacctgacacggatggggggtactggaagcttgagaccgtgttgcgcgaccgtgataaaccggaacggctgctcgtctaccctcggcaaaagctgtataaaaaatggcagccatttgaagaagagatccggctcgaacaggcaagatggggaaaattgttcccttggcttcatgatgaaaacgggcagctgcgcaatgaactcgaagaaaaccaagcatgggcattcttcgttcacgccagcgaaaagcttctcccgctcggtgtcgaaattatgctgccgtcctggtggtcatccgttaaaaacgccaatatgcggctgaaagctaaactgaaaaaaaacacaagctaccggtctttttttaatcttaatacggtgctcgaatttgactggcggatttccttaaatggggcagaaatgagcgaagaagcgttccaaaatctgatcaacaaggggcgccgctttgtgaaagcgggagacgagtggatcacacttgatccgaagatgattcgatcgctgcaggcgcttatggaaaaagccaaaaaagaggggctccatcttcaggatctgctcgcacaaacttccgaatccgaagaggaaacggatgaagaagaaacagaggatgtgcaggcgctcgcccggattcaaattgaactgaaccagtcattaaaaaagtttatccgaaagctttcccatctgaccgaaatgccatccgtcccgatcccgcccggatttcagggcgatttgcggccgtaccagcagctcggcttaaactggcttgcctttttgcgtgattgcgggtttggcgccgtactggcagacgatatggggcttgggaaaaccgtgcagctgatcgcttaccttctccatgtgaaatatacgaaacagccggaaaaaccggcgcttatcatctgtccgacatctgtcctcggcaactggcagcgggaaatcgaaaaatttggaaacagcttaaatgtcgccctccattacggaccgaaccgggaaaaagaaaaactgggggattactatcaacatgccgatgttgtactgacgagctacgggattgccaaccttgatttcgaggcattgtcagctgtggaatggagcacgatcgcccttgatgaagcgcaaaacattaaaaatgcggagacgaaacagtcgcgggcgatccggaaactaaagggcaggcactatattgctttgaccggcaccccgatggaaaaccggctctcagaactgtgggcgatctttgattttaccaataaaggctatttgggcacgttcaggcagttccaaaaacggttcatcgccccgatcgaaaaggatggatcgaaagaaaaaatccgcgagcttaagcgcctcattcagccgtttttgctacgccggacgaaaaaagatccggatgtggaactgaatctgcccgaaaagctggagcaaaaagaatattgcccgctgacggcggagcaggcggctctgtatgaagaaacggtgcaaaatgcttttaaggggatcgaccagctgagcgggcttggcagaagagcgctgattttgcagatgctgaaccggctgaagcagctgtgcaaccatcctgccctgtttctgaaagaagaaaaaccggcgcaccttttggaacggtcatttaaattggaaaaactggccacgctgacagaagccattttgaatacgggagaatcatgcctgattttcacccagtatatcgggatgggccagatgattcggcaaatgatgaaggagctgttcggtcttgacgttccgtttttaaacggaagcatgccgaaagcaaaacgcgaccagttgatccgtgattttcaaaacaaggcgttccctgtttttctcctgagcttaaaagccgggggaacgggcttgaacttaacagcggccaatcatgtcattcattatgaccgctggtggaacccggctgttgaaaaccaggcaacagacagggcgcatcgcatcggacagcagcggtttgtccatgtccataaattgattgcgaccggcacacttgaagaaaagattgacgccatgcttgaaaaaaaacaggcactgaacgacgaaattatccaaagtgacaactgggtaactgagctgtccgatgacgaattgaaacatttggttttgctgcaaagttaaagggagaggagtaccactttatgcctcctccccttccgttattttttgaatatttattattatctatgaaaaggaggggacgtaaccatgaaaaagtcttgggctattattggtatcattgctgccgttgttgttattggaatcatagttggtgtggttgtttatgaaaaggaaaagcccagctatccaaaatgggtgggccacagtaagagcggcaaatggactgctgtattatcgtataacggagagaaatatgaggatgttaactattctggagatttcatttggaatggctccaaaaaagaaaaaaagaaagtgtatgtcttgaaatcgcaatattggatcggtggtaaaatggaagttggagacaaaacggaagtgaaagaaagagtgtcaccggacaccggatttgtggagtatacagatgcgccgaaaaaaggagaacatccaaaagtcattatctattgggaagaaaataacaaagtccataaggaagtcattccattaaaaaagaaaaaatagtgctgaaaaatacacgtaaagccgctctgttttatgacgcagagcggccttttccgtttaatctttctttaaatgcctcaattaattgctcgccttcatacccttcgcggaccagctcctcgagcagtttttccgcatacgcgatccgtctcgagcgcattttcccttcgagcagaacgctgatcgtcccgtcaaattctcttattcccctaacccgggtcgaaagcggtgccggatcattgttctcgtaagtgatcacgacttcggtatcaagctccgtctgctgcttttctctttccgcaaaaaacggcaaatacttgcgctccgtgtacgcttcaatcagccaggtgccccttccgtcttccttgttcagaatcaacccgtcaatcaacggaatcgacacccgttcgccgtcattcaaaatggtaagtgacaggatcttaaatgttttcatccctttcctccctattcgtttgtaaaaattataacatacatccaacctacgatcaccgatcatgccaagtttctcccctcgtctcaaaagaccggtgactgccatgtttttgccggccgacaatgcccatctccatacgaaaaaaattttaaattataccatatcccttttttgtcgccgaaatttgtaaaaatcacgcgtgaaaaattgatttttgcccgaaaaaagggggcgatttttgaaaaatgacgattttacacgaaaatggaaagccggtaagataaatgcaggaagggggtggcacagttgattaaccaggtcacattagttggaaggcttacaaaagatccggatcttcactacacagcagatggaaaaccggtgttaaatgttacgcttgccttaaaccgccattaccggaaccaatttggcgaaacgttaaccgattttgtccaatgtaccctttggaataaaatcgcagaaaacacaagcaaatattgcgcaaaaggttccatgctcggcattaccggtcggattcagacccgccattatgataataaagaaggaaaaagggtttatgtcaccgaagtcattgccgacacagtccaatttttaagcaaacggccggaaaacaagccgctgcaaaaaaccggtcagggagggtagcatgcaatggaagatgcagcaaaacggttggatgcacttgagcgggtcttagcggatatgatcgtcaagcagggcatgctgaaccggcagcttgcacttttgatgcaggaagtaaaacggatagaggaagagagccgcaaaatgcccgcactcgtgccacacctgaagtaacgtaagagttttcctttcctaacttttttccatttaccagttcctaaatgtttctcctattttgccccatcagagagaatgtgtttgttatcaataccgatcctcttcttatccccttttcttttttgtcagctggacatccggctgattttttttcgggaaaaagcggcctggtgccccgtctttatttttcaagcgcaaacatgatttccgcttcacaggcaagctccccgtcgacggtggcaaccgctttgccttttccgaccggccctttcaagcggatgatttccacttcgagatgaagctggtctcccggtttcacctggcgtttaaaccggcatttgtcaatccctgcaaaaagcgcaagtttcccgcggttttcttccttttttaacatggcgacagcgcccacttgtgcgagcgcctccacaatcaatacacccggcatgaccggataggacgggaagtggccggcaaaaaagggttcatttccagatacatttttgattccaaccgcacgttttccttcttccacttcaagaatacgatcaatcaataaaaaaggataacgatgcgggagaatgtctttaatttgttgcaaatccaacattggcaaaaatcctccattttcagtttcaatccgggagcgaacaaggcgggggcaggatccaaacagctgccttccccgggatccgccttaaagtgcaagacagctgttttccgtaaaaaacgaatcatcaggaacggatgttatttacaaggcccatcatctggtcggacaatgtaatcgtctttgactggaactgatacaaccgttctgttttcgttagctccgttatttcagtggaaaggtcgacattcgatttttcaagcacgccctgctgcatagaaatctggctgcgggttgcacctgtcaaatctgtgtacacatttgccgcattaacgttttgcggcagtctcagcaagttgttcccgacctgttccagcacttgcggattgcgcatttggacaacgccgaggttaaagctttcccgcgtgccatcactgtatgccacctgcaaggtcccgtttggcctgatcgcgtaatctgctacattgccccgaaatgtaatcatcgcgttatgctcatccaggacagggttcccgttcgcatcagtgagcacacttctattgtttccgagcggggacacttccaatgcgccattgcgcgtaaatgccacttcatcactgccatttgcccgggcaagcacttttaaatactggttttcttttgtaaaggccatatcaagggcgcgtccggtatgttcaagtgccccctgcgatggggaaatgaccgcttgtgccagttttgcccccgtgccggtccggatgccgtacggcgtttttctgcctgtttctttggatgtatccggctggttgttgatttgctggacgagcagatcggtaaagctcgcctgtttgcttttatagccgtttgtatccacattggcaacattatggctgatggtatcgattttgtcctgcaactgcctgagcgtgttcgttgctgtcagcatggattgattcatggcgctatttcaccctaccattctccgttatacttttcctacgtcgtttacggctttgccgaggcttgcatcataagcctgcagtactttttgattggcttcaaaagagcggtaagcactcatcatatctgtcattgtttttgtctcatcgacattggaagattccaggaagccctgcttgatttgaaagccgttttggcctgcagccggcagcgcaccgttattcgcgagcgtatataaaccgtcgcctgttttctcaagctgtgccggattttgggcgtaagcaaggccgatcgtacctgcatagcgcccgttctccgttaccgcgccagccgcatcgacggaaaaatcggttccccctgtccgaatccggcccccgttttcatccagcacataatggccggaagcggtcgttaaatagccttccgggtttaccgtgaaattcccgttccgcgtatagacttcatggccgttgccatcatcgatgcggaagaacaggctcccctccggtgaagcttgatcgaatatggccaaatcggtccggttgcctgtttcttcaaggtcgccctgtttaaaaagcggcagtgtttcctgcatgtaaacaccggtcgcaagtgacccgaccgatttcaccacttcgcctgttgtcccgtttttatccatataactgagcagcattttcgggaaagagcggatcaatgactggtccgttttatatcccggcgtatctgcgttggataaattattggcgagcaaatccgtttttcgctgctgggcgatcatcccggaagccgctgtatacaaaccccgtaacattgccattcacctcgctggagcattcatcaaacgtttgattaaacgagttttctttttgaaattttatcgatattttcaagcatgacgcctgttccgatcgctacagaactcatcggattttcggcaacaaggaccggtactttaatttcttcggcaagcaattggtcaataccgtgcaaaagggccccgccacctgttaaaatgacaccacgatcaatgatgtcagctgacagttcaggaggcgttttctccaaaacgtttttcgtggcgtggacaatgatggatacggattcacgcagcgctttttcaatttcagcagatttaatcgtaatcgtccgcggcaagccggaaaccatatccctgccccggatgtccatttcttcattgcgggcgcccggaaataccgtgccgatattcatcttgatattctccgccgtccgttcgccgatcagcagtttgtactcccgttttatatactgcagaatttcattgtcaaatttatcaccggccattttgatggacgagcttgtcacgatgtcccccatcgatagtaccgcaatatccgtcgtgccgccgccgatatcaaccaccatgttcccgctcggctggaaaatgtccatgcctgcaccgatggccgccactttcggttcttcttccaggtaaacatttttcccgccgcttttttctgctgcctcgcggatcgctttctgctccacgctcgtaatatttgtcgggcagcaaatcaaaatgcgcggtttcgataagaatccctttacattcagcttgttaataaaataccgcagcatcgtttctgttacgtcaaaatcggcaatgacaccgtctttcaacgggcggatggcgactatattgcctggtgtcctgcctaccatgcggcgcgcttcctccccgactgcgagcactttattggctgttttctcaatcgccacaacagatggctcattcagcacaattccctggccttttacgtggatcagtacattcgcggtacccaaatcaattccgatatcctttgcaaacatgtatgtgctccttcctcatttttcaaacttttttaggacgatttatctattcgaagtctatcattgtctgttatccctgattatttattttagcatatttttgccgggtttcgggatcatttgtcaaattttattttcgggtatttttcaagcggggtaaacggaggggattttacaggggccggtctttcaaaaaagcggcttccgcatgggtgtcctttttaattttgcgacagctgtttaccggatggaagcagctgcgcactgtcaccggaatcgttccccaaaccgatccggtccgtaaaaagaagcaaccgcgcaattcgattgcttctttcagggatcatggagccctcatgagccggaaagcgctgctaacggttttgctgttattctgtgactggatactcttcttttttatatttttgcttcgttgcttcccctccgcgcaaatggcggacagatttatggtaatcgaggatatcctttacctcatttgccagttccggattgatttccggcagcctttccgtcaaatctttatggacagtacttttggatacgccaaactctttcgcaattacgcgaactgttttcctcgtctccacgatatacttcccaatcttgatagtcctctctttgatgtaatcgtgcacactactcgccctccccaaaaattggatgtgaggcgtgtgaaatgagactcgctggattcaattttgtactgggtcccgcaggctgttcatgcttgcggcagaaagtgaagcctttctgatggtgcagaatataatcaagtctgtagcgaagatgttcccgtcattaacgattcctcacctcaaacactctcgcttttttgtcaagtttgtaacagtttattagcttgtgtaccattttatgcaagaaactgctttttttacgggaagcaggcggaaaacataaaaaaaggacagaggttttctgtcctgtttacagcgcgggctgtgttttaatgacttttctggctggttgatgttttttcagaagactggctttgcttagactggctgctatcagatgaaacttccggcgttttgacgtcgctgaccgttttattgaagtagccttccggattgaccgctacatcatctttgcggatttcaaaatgaagatgcgtcccggctgctttgttcagctcgctccggccggcttttgcgatcgtttgtccttgcttaaccgtatcgccttctttcaccgcaatgtcttttaccgattggtattcggtcgtcacacctttgtcatgttcgacttcaatgacattgcccaaaacagcgtcttcctgcacttttgtaacagtgccgcccattgcagcgacaacgtcaaatgttttgccatttttcatcgtaatgtcgactccctggttcggctggtacgtgttgccgtatacaacaagtgcggcttcctggtccttgacggaagcattcgcatcgtaaaacttcttctcaatcgtggccagttcaggtttttgtaccggcattctgaagttttctaccgctttgtttacttcgattgcttcattgccggatcctttctggctgatggatacatcgtttttaaatttttcttttgccgaatgggttccaagcgactgataccaaataatccctgtaatcaacagcaccgcgcttactaaatagattgccggatagacccagcgttttttgaagaaattttttatgttctttggttgagaaggccgtttcttttcttcctctctcatttatcatcacctcagcaaccattctgaacatttcttcatttgtttatacatcaagtttaaaaaatttttgtctcgaaaggggttatttttttgctagggcgccggctccggcaatttggctgaatggctgaaccgtgacgccttgataataatacgccacaatcgctttataatctttcccttcctgtgccatgccgtttgccccgtactggctcatgccgacgccgtgcccgtatcctttcgttgtaatttcaatttcatttccttttctttcccatgtaaaatctgaagaaggcagccccagcttttccctcacctgcctgccggtgaaaactttgccggcaattttgattttcgccactctttttccttctgtcctggataagacggttcccgtatcattcgcttgcatccggaccccgagtttttgttcaaacgccgtgacagggatggatgtgactttcttgaattttggcgaggtttgatcccacgggcttttcacgctttttaaatatggaacggcattggaccagtaatcgccggcattttctgtgtaaccgttgctggttgagaaaaacgctgcatcgatcggcttgttatggtaagtgataatttcgccttctgttgcagcgaccgctttgttgattttctccattttttcctgatacgctttcccccaaacgtttttcagttcatcccggctcaaatatacctggtcgttgaccgtatctgtcacattggcattatccggcaaatccctgtttccgccatttaacatccggttgacgatgaaagtgcgggcagtcagtgcctgggcttttaatgcctcaagtttaaacgttgcaggcatttcagctgcgaccacgcctgcaacatagtcttccattggcacgcggtcaacctttttctccatgcttctgtatacggatacctggacggatgccgcttttttctcctcctttgccggttttttttcatgcaattttccgctcaccttgtcgttgtggaacggaaggacgacgagggccggaataaggaaggaaaaggcgagtacgaggatcgctgcgactacaacaggtttgattggtttcatgctgacgcctccatatggtcgaagtggtgaaaagcctatactccaatttatgggacgggacaagcatttatgattaaaaatgcatgctagaacgttgtgggggacaagcacggggcaagcatttgccggcactgaaaaaaagccaccgaaccgtccggcgcgcttatgggcaaaggaggagagatgcacatcggaaaagttgcggggcgcacgcttggggcaggagagaacgcactggccggcgtttcagcataaactgttcaacaactatatgaaaaatcaggacctatacgtttgaaaccggcccgttttgtccataatgggaacagcggcagaaaaatggcgaaaaaaaaaaccctgcacatggggaatatgtacagaggtttttatacaaactagagattggcgtcagcaagcaactgatcttgttttgccggcgcaacttccgcttcatcgtcgaccctttcaatgttggccccaagtgcagccagttttaaatgaaagttcaaatagccgcgatccagatgttttaattcggtcacccgggtgatgccttttgccgccagcccggcaataattaaagcggcggctgcccgcaggtctgttgcggcaacttcagccccctgcaaattgcacggcccgttcacaataaccgaacgcccttctatttttaaatccgcattcatgcgccggaattcttccacatgcatgaatcggttttcaaataccgtttccgtaatcacgctcgtgccttcagcacacaaaaggagcgccatcatttgcgactgcatatcggtcggaaatcccggataaggcattgtcttgatgtctactgcctttaatgtttccgggccgataacccggacgccgttctcttcttcaatgatggttacacccatttcctccagttttgcaattaaggaagaaatatgctcaggtaccgcaccttttaccaacacatttccctttgtaatcgcagcagcaaccataaatgtccctgcttcaattctgtccggtatgatggtatgatcagcagcatgcagcttctccacaccttcgatcttgatggttcccgtgccggcaccttttacattcgcgcccatttcattcaggaaattggcaagatccacaatttcaggttcttttgcacagttttcaatgaccgtttgtccgtcagccagcgatgcggccatcataatattctgggttgcgccgacgcttggaaaatccatatatattttcgcgccatgcaagcggccggataccgacgcttcaataaagccgtttcccacatctactttggcgcccattgcttcaaatccttttaagtgcaagtcaatagggcgggatccgatggcgcagcctcccggtaatgcgacccttgctttcccggttcttgccagtaacggccccagcactaaaaaagatgccctcattttgcgtacatattcaaaaggcgtttcaattgataactcccttgatgcatctacagtgatttcattctccagaaacgtaacttcagcattcaggtggcgcagcacttcactgattgtaaatacatcggagagttgtggtacatcacgtatgatgctttttccttcacttgccaataacgatgcagcgatcacaggcaatacggcattctttgcgccttccacttgaacggcgccctgaagcctgtttccgccgcggacgatgatcttttccaagagtattcccctccgcgtccatattctctatattaatattcaatcgtaatgatgggtgtgccaattacgaccgttgtcttaccgctcaaaccgctgtttcgcaaaccgatttgcacattcattttccggtttttggcatggatattttcagaaaacttaggcgagtatccggaaactgcataaaagttcttttcttccattgtttcagtttctttcgcatcaagacgtttcagcagttgttcttttttttcatgtaacaaaacacgatccattttatcactgaattcgcctttgatacaagagaaaaccatgggctttttcgtaaaaagcgctcgagtgcgggcagataccagttgattgactttacgcatttgcgcgcggtcccatcctttgccattcacttcataaatgatatacgaaccgttttcagcatttgatagggtcgacataaattttacggtttcgacataatggcttttttccagcttgcccgtgagcaccttcacatgcctgtccttttttaccgaccagtgcatttcagggaatgtatcctgcaatgtctgcactttttcggcccattccggttcggacggcgccctcaggggttctcttgtatataaagaccattcagtgactttgccgtttaattttgcaatggacgcctgaaataactgcaattgatccgtaaaattggccgcatctgtcttattccccatgaaaataagtgtcaaaccaacaattgccaaaaccggatatacaaatcggaatttcatctttgcgctcccctctctcttattaaaagtgttaacaagagagacggcagaaataccaggtaaaagtcgtcaagttttgacaccctatacactagtataatgaattttgtcaaaaaagcatacctaaattgtatgcaacagatgattttttggaaacaggaaaaatgaaccattttccagcctcaaaagaaccaatcaattggaattttgaaacaatgcttgacgacacccgtcattggaacaggaaatgcaggcgctgcgcccacagcaaataatcaaggaaaaaattgctgacgctgtatccgattgcgacagaaaggaaaatatacaagagccttgcctggacaatgtggtttttctttatgatcttttcaatgtggacggcttggaggatccaaaacgtcatgccaataaaaaataaattcacaaggatgctgagcactgcctgcgttccgaattcggctgtcatctgtcctcattcccttcctgttttagtccgttcaggcgcctgcccggtaaatcagccgcttaaagaaaaacaccttccgaaaaagcagaaggtgccgttattttgatcataaaatgacaatatggaaaagcggttatctggaaaagtggcggtagacatcaatccggttcatcgcgcgttttaacgcaagctctgcccgtttaaaatcaacatcatcctgatgggactgatgcaatcttttttctgcgcgctgctttgcttcttccgcccgccggatgtctatctgttcgggggtttcggcagcctgcgccagaatggtcacttgattggaccgtgtttccaaaatgccgccgctcactgcaaccactttttcctggtcgccgtttttaaaccggacaacgccgatatcaagcggcgcaacaagcggaacatgcccgtacaggatgccgatctcgccgcttttggcctttgcaataaccatttctacttccgcattgtataccgggccgtccggagtgacaacactggcttcaaatgtcctcattttgcttcctcccggtcccgtattatacttttacacccatggcttccgcttttttcacagcatcctcgatcgtgcctacgaggcggaaagcatcttcaggaagatggtcgtatttcccttcaagaatttctttaaagccgcggacggtttccttaaccggcacataagatccaggctggcctgtgaattgttccgcaacgtggaagttttgcgacaggaagaactggatgcgccgagcccgcgcaacaatcattttgtcatcttcgctcagttcgtccatcccgaggatcgcgataatgtcctgaagctcgcggtaacgttgcaatgtttgctgtacctggcgggcaacattgtaatgctcttccccgacaatttcaggggacaatgcccttgatgtcgaagcgagcggatccacagcaggataaatccccatttccgacaaacgccgttcaaggtttgtcgtcgcatcgaggtgggcaaatgttgtggccggagccgggtcagtatagtcgtcagcaggtacgtaaatcgcctgaatggaagtaatggaacctttattggtcgacgtaatccgttcctgcagctgacccatttcggttgcaagggtcggctggtaacctacggctgacggcatacggccgagcagcgcagaaacttcagaacctgcctgtgtgaaacggaaaatattatcgataaagagcaatacgtcctgcccttgctcatcacggaaatattcagccatcgtcagccctgttaaagcgacacgcatccgtgcgccaggcggttcgttcatttgtccgaacaccatcgctgttttggcaataacgccggaatctttcatttcgtagtagaggtcgttcccttcacgtgtccgttctcctacgccggcgaatacggaaataccgccgtgttcctgtgcaacgttgttaatcagttcctggattaacacggttttgccaacgccggcaccgccgaacaagccaatcttcccacctttgatgtaaggcgccaaaaggtcaacgactttaatgccggtttcaagaatttcaacctgcgtggataattgctcgaaagaaggcgccggtttttggatcgggtcgcgtcgcacattgcctttcagttcgccgtcaaggtcaatgacttccccgaggacattaaatacacggccaagggttgcttcccctaccggtacagagatcggcgcacctgtgtccaccacttccatgccgcggcggatgccgtctgtggaagccatcgcaatcgtgcggacggcatcatcgcccaggtgtaatgcaacttccagtgtgacattgatatccacttcattggcattttttgctttataattgatttttaatgcgttataaatatcagggagctgaccgttttcaaactttacgtcaactaccggacccattacttgcagaacgtgtccaatgctcatactgttccctcctaacttgcttgatggcacatgcccgttccgtttcggcaaaagagcggtttgccaaaacggaaattattccagtgcagctgctccaccgacaatttctgtaatttcctgtgtgatggatgcctggcgggcacggttatatgtcaatgtcaacgagtcgattaattcagttgcattgtccgtcgcatttctcattgcagtcgtgcgtgccgcgtgttcacttgctttgctgtccagcagtgcgccgtaaatgaggctttctgcgtattgcggcagcaaaacactcaggatttcttctgcagatggttcaaattcataggaaatgagccggtttgtcgtcgttacatccgtaagcggcagcagccttttttccgtcacatcctggctaatggcgctgacaaaatggttgtaatacaaatacaactcatcaaatgtcccgtcttcatacatcgcgaccgttttctttgtaatattttcgatatcctggaatgtcggatggtcagacaggccgacaatctgcagcacaacattcatctttagacgcctgaaaaattcgtatcctgtacggccgataacaataatcgcatattcatcatcagattgatggcgttcccgaatggtctgggttacaagccttaaaacgttgctgttaaaagcgccggccagtccgcggtcagatgtgatcacgaaataaccggtccttttaaccgggcgggaaacaagcatcggatgccggacgccgcctgtcccttgggaaatgctgaccactacatcctgcattttctccatgtaagggacaaatgatttggcggacaattccgcacggttcagttttgcagccgacaccatctgcatggccttcgtaatctggcttgttttctgcgtagagttgatccggttttttatatcgcgtaaggatgccacttcacttcaccacccttgtgagttaatcaggattccaatcccggattgaaatcctttgtcttatccggcccgtttgccccgggaatgatgctgcagtgaaaaaaaaacgcatgctgcatacgggtaacggggttctctgtccaattattattgctgttcagatgctacgaaggtctttttaaaggcttgaatagcttctttcattttttcatcgtcaggaagatttccggttgtacggatttcttcgagcagggatgcccggttctggtccagccagtcataaagttccgattcaaaacggagaatgtcttccactggaatatcgtccagcaacccttttgttaatgcatacaggatgcatacttgtttttccactttgattggcttgttcagatcctgcttcaatacttcaaccgtacgctgcccgcgtgccagttttgcctgggtggctttatccagatccgacccgaattgggcaaatgactcaagttcacggtaagatgccaggtcaagacgcagtgtaccggaaacttttttcattgccttgatttgtgcggcaccgccgacgcgggatacggataaccctgcattgatcgccggacggacacctgagaagaacaaatcggactgcaggaagatctgcccgtctgtaatcgaaatcacgtttgtcgggatgtaagccgaaatatcgccggcctgtgtttcaacgaacggcaatgcagtcaatgaacctccgccttttgcatcgcttaatttggcagcacgttcaagcaggcgggagtgcaagtagaatacatcgccaggataggcttcacggcccggcggacggcgcaagagcaaggaaagttcacggtaagcaacagcctgtttggataagtcatcatatacaacaagcacgtgttttccgttgtgcatgaattcttcacccatcgcaacaccggcatacggagccaggtattgaagaggcgccggttgtgaagcggaagccgttaccacaatcgtataatccaaagctccgaatttgcggagcgtttcaactgtaccgcggacggtcgattctttctggccgatcgcaacataaatacaaatcatgtcctggtctttttggtttataatcgtatcaatcgcaatggtcgttttaccggtttggcggtcgccgataatcaattcccgctgtccgcggccgatcggcacaagtgcatcgatcgccttaatccccgtttgcagcggttcgcttaccgatttccggtccattacgccaggcgctcttgattcaatcgggcgggttttcgttgtgttgatgggtccgagcccgtcaaccggctggccgagcgggttgacgacacgaccgatcagttcctccccgaccggcacctgcatgatccggcctgtacgccttacttcatcgccttcatggatttcgcggtaaggcccgagaataatgatcccgacattactttcctcaaggttctgcgcaagccccatgacgccgttggaaaattccagcagttccccggccatcgcctggtcaagaccgtgtgcacgcgcaatcccgtcaccgacttcgataacggtaccgacatcgctcacttcaatttcagactggtaattttcaatctgtttttttatcagcaagctgatttcttcagccttaatgctcataaatccagcacctcatttctcacttaactgattaatgttttttcaagccgttccaattttccgcgcaaactgctgtcaaaaatagagtttccaattctgatttttaatccggctagcagaccgtcatccacgatattctcaatgtttaaagacagctttccgacttttttggcaaatacttcggatatcgctttgctctcgtctgcagaaagcgggcgggcagagtagacaagtgcatctgtaatgccgcgttcatcattcacccgttcaataaaagcacggcataccctcggaatgagctcgtccctgtgccgctcagtcaagagcaacaacaaattcaaagtgaaagtggataatccggaaaaaatgtttttaaggatttcttgtttcttttctatcgtcaatttcggagatttaaggagctttcggaacggttcgttttcctcaaaaacctcttttaccgcccggacttctttttcgatctcttgaagctgcccgtgctcttttgcaagctcgaaaagtgccgaagcgtaccgtttttctaccgcctcattactcatttcatttctcctgcctctttaatagaatcgagtatgaatttctcatggtctttctcggaaatttctttttcaatcactttagaggcaatcatcacggacaaggatgctacctgttcacgcaaagcagcaacagcttttgctttttcctgttcgatttcaactttggctgcatctttcatgcgttctgcttcctgacgcgctgttgcaacgatatcatcatgctgcacttctgcttgtttccttgcgttttcaattaaattctgaccttcaacgcgtgcttctttcagcaacttgcgctgttcttccaaaagcttggctgcttcttcgcggtttttttccgccgtttcaatttcttttgcaatatgttcctcacgtttcctcatcatttcgacaagaggaccgtaagcaaattttttcaatagcagaagcaacacaacaaagatgatggcctggaataaaatatcgcctgtgttgagcttccctagcacaaatccgagtactaaatcagtctgggacacccgggttcactcccttccacacgttcttaaaacattctttcgcaccctttaccaaaaaagaagcaaaatggttcaaagaagatggccttgaaccgctcaaaacaaaagccacaacgattcttggctaaatcataaaggaaaggcgaaggtttcttagaatccgcttcgccgtcaacattttccttatcttcccagtgcaataaatgcgataacaaccgcaatgataggaagagcttcaactaagccgatgccgataaacattgttgtctgcaaaaggccgcgtgcttctggctgccttgcaatcccttcaactgtacgaccgacaataaggccgttaccaataccggcgcccaatgctgccaaaccaactgcgattgctgctgcaagaatacccaaactcatgataagatttcctcctttggaatatataaataggtgatttttcaaaaatatagaaatggttattcctcatgggcaatcctatgagaaatataaaccattgttaacatggtaaagatatatgcctggatcgtgccgacaaaaatagaaaatccttgccatacaagggtcggaataattgctccgattgtcccccaaatgtttgtatgcatcgccaaagtgcccgcaagcagcgacagcaacacttcgccggcataaatattcccataaagccggagccctaatgttaatgtgttggcaaactgttcgatcaggttaatcgggaccagaaaccataacggttcagcatagcttttcagatatccgccaaaccccctctttttgacaccgtaaaagtgggacaggcccatgaccagaacagccagcgtaagggtaacaaccgggtcggaagtaggtgacttccaccaggaataatggtcataaacaaccataaacggcaatccaagcatattggaaacaaagatatacatgatcagtgttagacccagaatgtgaaagacgccgccggttttccagtccatattgcttttaatgatccctcttacaaaatccatgacccattccataaaattctgcatgcctgtaggtttcaacgccaactttcttgttgagatgaccgcaatgatgaacacgatcaatgatgagacagtaatcatcatgacgttggacaggttaaaatacaaccccatgaattcaactatcggttgcttatgttccaccgaaactcacctcactttacttttttctttgttgaagcaaacctacaaaaaaatctatcataatgaccagataagatgtcattacgccaatcactacagctaaaagatgaaacaaatccggaaaacggagcgccaccgccaccgcgaggacagcagtcgccattctcatcccggtaccgagcgagaccctttttttgcctgaggaaacatcggtaaccgccaatgttttcttcaccataagccataagttaaagaggctgacagctgtgccaagcaaaagcccgaggaaaacagagcggcaaccgggaaacatcgcccccgccaaataaaggcacaaaagaatcaccaaatacttgcgcagccttttgtagatacgtagaagttccggcatgccttaaacactcctgacaaggggcgccgatcaattgcagcacagcaggaaagcggtatgtcacttcacctggcaaatcgcaacattcttaaccaaaacttacaatttgttaaggttacgagtagcctgcagctccggctttactggtttttcagatttccggcatataaatagtagaatcccaaccatatgaaaaccttctcattatgtacacttttttagcatacaatagcgcttatccaatgtcaataggagtttccttgatatagtcattagaacttatttttttcgagaaaaggtcatcccgcttcccgaaataggaaggaaacgcccgcactggcgtaagcttgcgccctttttccaatcgtttacatacctggcattcatctatataccgaaaacataccgttattatagaccctttttatttttttaccagcctgtttctgcagggttaacaaaattgtaaaacacgaagcgcatccatacattttattttgttccaaacaggcggtcccccgcatctccgaggcccggcacaatgtacccttgctcattcagcttctcatcaagggctgctgtataaatatcaacgtccggatgggctttctgtacggcttccgcaccctcaggagatgcaatcagacacatgaatttaatgttttttgcgccccgctgttttaaggattggatcgcatccacagcagaaccgcctgtagccagcatcggatccacaataataaaatcgcgttcctcaacatcgcttggaagttttatgtaatattcaaccggcgtcagtgtcttcggatcgcggtacaggccgacatgtccgacttttgcagccgggatcagtttccgcacgccgtcgaccatgcccaggcccgcacgcaggatcgggacaatgccaatttttttgccggataaaatttttgattttgccttgcagaccggcgtttcaatttcaatttcttcaagcggcatatcgcgggtaatttcaaatgccatcaaagtcgatacttcgtcgacaagttcgcggaattcttttgtccccgtatgtttatcgcggatatacgtcaacttgtgctggatcagcgggtggtcaatgacatgaagtgtactcaaatgaattctctcctttaaaggttggtatcaggttcggcaaatgcttaccccaaccattttacacgaaaaaagcgcccaatctcaaggaaagccaaaagaaaatcctgaggccgggcgaaaggatccagccccgcgttttacggggccttcctgctcaattttttgctggttctgacctgaatttgtttttatgccacattggaagcggaccagccatccgcccgaaaaaagcgggacaaaacccctgcttagttttggccggcgtacagcgggaagcgttccgtaagatgcttgacgcgtcctgccgcttcttttaagaccgcttcgttatccggatttttcaatgccgatccaataatggatgccacctcatccatttcttccaggccgaatcctcttgttgtgactgcgggcgtaccgattctgaggccgcttgtcacaaacgggctttccggatcatacggaatcgtatttttattggccgtaatgccgatatcatcgagcactttctccgcatccttcccggtaatgccgaaagaacgcaaatcaatgagaatcagatgattatctgttccaccggatacaaggtcaaatccctctttttggagcccttccgccagccgttttgcgttatccaccactttttgcgaatagattttgaacccgtctgtaagcgcctctccaaaagcgacggctttagccgcaatcacatgcataagcgggccgccctggatccccgggaaaatcgatttgtccactttctttgcaaattccgatttgcataaaatcatgccgccgcgcggtccccgcaatgttttatgcgttgtggtcgtcacaaaatccgcatacggcacagggttcggatgtaacccgcaagccacaagccctgcaatatgcgccatatccaccattaaataggcgccgacttcatccgcaatttccctgaactttttaaaatcaatcgtgcgggggtatgcacttgcaccggcaacaatcagtttcggcttatgtacgcgcgctttttccaatacatcttcataatcaatatgctgcgtttccttatccacaccgtattccacaaaatggtactgcatgccgctgaaattgaccgggctgccgtgtgtcaaatgcccgccgtgggacaaattcatgccaagcaccgtatcgccgtgctccagaatggtgaaataaaccgccatattggcctgtgcgccagagtgcggctggacattgacatgttcggcaccaaaaagctgttttgcccgctcccgcgcaaggtcttccacaatatccacatattcgcatccgccgtaataacggtgccccggatagccttccgcgtatttgttggtcagaacggagccttgtgcttccatcaccgcttcgctgacaaaattttcgctggcaatgagttcaatcttgtttctttgccggttcaattcctgccggatcgcctcgtaaacttccttgtcttgatttgcaatatggctcaattcggtaccccctcaagattgttttcatattcttttttattttaccataatgctttgcaaaatttgtccatttttttgacaggaagaaaaaaaacatgccccgcatacaatatgcagggcagtatgggtggtcccttattccggctgttctttttcgtaaaccgcccgcacgccgccgatcagtttcggccgcgttttggcaaatgtaacatgggcttttcccagctctttttcggaaacccttacaggtacggcaacatgctttaagtgcatgccgatcaatgtatccccgatgtcgatgcccgcgtcagcccggatatattcgacgacaacgggatcttccatgtgagcgtatgcatacgcagccatcgcgccgcccgccttccgaacaggcacgaccgtcacttcttcccaccccttttcatcggcgagcgaacggtcaaccacaagcgcccggttcaggtgttcgcagcattgaaatgccggttggaatccgaactggcgtgcaaacttctgtacactgtcataaataatggcggcgacatccattgcccctgctgtcccgatttttttcccggttacttcggatgtcgagcagccaacaacaaaaacctgtccttttttcattggcacctgccggaaaaattcatccagcatgcggtccaactgttcttccaaacgtgccgaatctgattgcaacaaaaacacctctgttatttttgttcatactgcgcgattttctcaatcctgcgtgcatgacggccgccttcaaacggcgttccgagccattctttcacaatttcacaggccagccccggcccgatgacccgctctcccatggcgaggacattgctgtcattatgggcccttgtagccttcgcgctgaagacatcatgtacaagcgcgcaacggataccctttactttattggcggaaatacacatcccgattccggtgccacaaatgaggatcgcacggtcaaattccccttttgccaccttttccgcaaccggaagcgcgtaatccggataatcaaccgacccttcacaatcgcatccgaaatcttcgtaggcaacacccagatcctgaagcaaaccggcaatttcctgtttaagatgcttaccgccgtggtctgaagccaatgccactttcatgttcttccccctccttcatgcttctgattctattgtggcacagaacgtcgaaaaagaaaataaagcgtcttagaggccaggttccatggctgttaaaatttccggcccgtttaaaacgtccatcgtccccggaaaaatgccaggcatacggccgcatgttcccgcatctcctcttgtcttgcgggatttcccggcacaaaacctgaattgccgcgcttcttccagccaaaaccggtgctccccgtccaaaaccaggcgggcgaaaaactcaccggatatgaaagcggcgggtgctcccttttaatttctccgcatcctgctcgagctgcgcgataagcctttcaatcaattccatgttctgcgcctgctcatttgtaatcgccgtgacttcttttgccccggcagaagtctgttcggtaatggccgccacttcctgcgactggctcgaagcttcgtgaatcgcatccatttggttcttggccataccggcaattttttcaactgcccccgcaaccaaatggatcgattccgtcattctgtccatcgcttcattggccttttgtcctctgcgcacttcttcattggctttttgaacttgtacagtcatttgttcgacaacccgtgtaccttcctgctcaatgtgctggatcatcccggtaatgccctgaacggcctgggcactttcatccgcaagcttccggacctcatttgcgaccaccgcaaacccgcgcccgtattccccggcgcgtgccgcttcaatagaagcattcaacgccagcaaattggtttgtgccgcgacttcaccgacaaaagaaatgatcccctccactttcttcgtttcttccgcaagatcccgaacggcttccagcgagatggtattttcttttgccagattttcaacacctgatataagtgagtccattgtctctttgctcgtctttaattcgctcagcatgtgatcagaagattttttgcaagtatccgctttcccgcggacttcggatgcaagctgataggttttttcaacgaggtcagccgtagattgggtggcagccgcggattgctcggcgccaagtgaaatctcttccaccgtcttgtttacatgttccgcctggcccgcagccagtgccgttttctccgatatttccgacacactttctttggtgcgttccacattttcatcaatttgttcaaccgtctcccgcaaattggaaagcaaggaattgaaagccgctgcgagcgactcaatttcatcgcccgattttggcacggggacttcatctcttaaatccccgcggctcgctttaagggctgcatcttctaacttgcgcatcgggcctgcaatcaggaatgaaccgaaaaagcttaaaatcccggaccagataatccctaatgcaagtgtaatgacaataaaccacggcagctttatccagtcggaaaaaaacggataaataagataaatgaaaagaccgcttgccgaatatgtaataaaagacagcccggttacgaacaatacaattttcttcgttaaactgaatctatagcttcgcttttccatccgtcacacccgcccctggtttcccgttttcctgtttttaatcaaacgattgatcaatgcatgcaattgttgataagtttctctgtaagcatccaggctgccgccgtacgggtccggtacatccccgctgcttccggcatactccgcgatcgtaaacgttttattgcgggcatgcggataccgtgctgccactgcctgtttgtgcccggacgtcatcgtaagaatcacgtcagcccaacccgccaaattctccgaaaggttccgggcgtggtggcggaaatcgattccattttctttcagcacctcgtaggtatggacagaagcgtcttcaccctcgggcgcaaaaaggccggctgattccacttcaatgcccggcagctgtttcgcttttaaaatggcctccgccatcgggctcctgcatgtattcccggtgcaaacaaaaaggatattcaaaggctgtccccctatcctgaacgatttaaatctactattattatagtaaaaaagaccttaattacaaggttaatctgtagatagataaaaaaagccggaaaattgaaaccggctttactaaatagaaaacaacaatttgagcccaaaaacaacgaggatcgttcccccaagcacttcgccgtacatcccgatccagccctggaatttcctgccgatcaaaaggccgagccaggttaaaaatgtagcagcaacgccgaagcaaatcataacagcaacagtccgcacgccgaaaatgccgagtgacagcccggcagaaaaactgtccaggcttacactcaacgcaaacaacatcgttccccatccggacgggctgacagcttgcgccccctcctttttgaagacccatacaatcatctgtatccccataatcacgagcaatatgccaccaatatactgggcaaataggccaaaagtatgggagagaagatggcccgcaaaaacgccgagaaccggcatcaacacatggaaaatgccgaccgttaaacctatgtaaaagatttgcctcagtctgggctgcatcatgcccacgccgaggcttaccgaaaaagcatccatgccgagcgccaaagccatgatcgccaaagttaccatttctgcgatgactgccatctctttttccccctttggacgtgcctactccagcttatgcacgtccggggcgttttagaagccgcagatcatccgaaaccgcccgcgcacccgatccgcaataaaacagcaccaagcaataagggccgtttggaagcgtccgggttactgaacatcctcttcttttacataacgatgccccgctgctttctcaagccgattcataatcgcccggccgatgccttcacgcgggaaaatttcagaaaatatcacatccactttttgttcatcaaacgatcgaagtgtatcatacaagtgccgggcaacggtctcaagggatgcccgcctgccacaaactgcgaccacatcagcacggacgataccggacgtttcttccgtcacaatcgcccctgttacttccccttttttccggtgcgcatcgatcatttgctgcataaaagccgtgctgccgtccacaagataaaccggcgcatccggcgcataatgcgtatatttcatgccgggtgctttcggccgggcgccagtccccttaagccccggatcaagcctgacttttccaatccgttcttcaagctgttctttcgtaacaccgcccgggcgcaaaatcacaggcacttccgctgtcacatcgagcacggtcgattccactccgacacccgtttctccgccgtccacaatgccggaaattttaccggcgagatcttcccggacatggcgggccaatgtcgggctcggcttgccggaccggttggcactcggggcggcaatcggcagcccgctcatgcgaataagcgccagtgcaaccggatgccggggcatgcggatcccgaccgtgtccagcccggccgtcaccttttcggacaatgcccctttctttacttttacaacgagcgtaagcgggcccggccaaaaagctttcatcagcactttcgccgtttccggtatttcttccgccaattcttccagctgcttttcctccgcaatgtggacaatcagcggattatcggatggccttccttttgccttgaaaatcttatccaccgcttcatcgcttgttgcatcggctcctaaaccgtataccgtttcagtcggaaaagcgactgtctgcttctctttcagtaactgcgctgcttctgcaagttgtggataagtaccgggattctccacagttttatccacaacccagtattttgtttccattctttttcacctttctccatccaatcatcggtcctgccaggatatttatttatcaagttttcttccggcaagtatacaaaagttcgaaaaatgaaacaagtattatccacatcttgtggataatacttcgcattttgttgataacccgtctttgttccagcccgtttgtccgacctttccacaattcgggcggaaaatgttaaaacagttccttgatcactttcacaatcagcagctttttctccacctcgccatcatctccggcgtaaacagcgctagtgtgggttgctgtttcaccggctggctgtttggtttcgcggtcttgtgcctctgcctgattttcatgcggtttccggttcgctttttcagttgccggctcttccgcaggttttgtgcgggcattggaagtcgcaaccttctttgtttccggtttcttttcttcacccctgctgcttgttgcaacgccgttggaaaaatcgagaaaacagaggggcggatacaggacgcaccaccaattggcgcccttgccttccccgagtgtaatcagcaccgcttcatacttcccggccggatataagtactggccgtataattttgtcggaaaggcgaccttaccaagttcggcttttaccggttcattcagctgttcttccgccataacccttcttgcaatgctttcaatttccggcaagtgggagcggatgactttttccgcttcttttttggaatttaagtggcccacccatttggtgatgttcgcatttacttcatcgcggattttccgttttactgcctggtcttccggcttgtcactgtttgccagaatgcgcagccggatcgcatcttttggaataacgatggtttctgcctccgccgctttttgtttcggtgcatataaactgatgatcgttgcgatcgataacatgaaaatatacaatgaaaccactgtttttcttttcattttcttcccccgtcccttcatattcccattgtgggcaggaacagaggattttaaactatgaatctgaaaaaaatctaatttttttcgcaaaacaccatccgctcatggccgttgatatcgcggaccacttccacaacgctttccggaaatgtatcccgcaacaggcaggaaacgcgctccccctggcctgaaccgatttcaaaaccgacgagcgcccgcttgcttaaaacagacggcaatgtttccataaagcgccggtaaaacgcaaggccgtcttctccgccaaacagggccgtttcagggtcatggtcgcgcaccacaacggataacgagctccggtccgtttccgggatatacggcggattggataaaacaatgtccaatttctcgccgtgtataaacggttggagcagatctccgtgcacaaaccggatatccgcatgcagggcttcagcgtttttttcagctacggcaagcgctttttccgaaatatcggaggcgtacaccaaaagctccggcaactccaatttaattgtggtcgcgataatgccgctccctgtcccgatatctgccaatttaagcccttttgtttccccgaaatgacggcggatccgtccgattgcaccctgcactagttcttccgtttccgggcgcggaatgagcacatccccgttgacaaaaaatttccgtccgtaaaaggtttcatagcccgtaatatgctggaccggaaccccttttgcatgggcttcggccgctcgccggaactttgtctccacatccggaggcaatgccatccgcaagttggaaagcaggcgggtgcggcccatatccagaaaatgtccgagcaagatctccccggcttgcgcgtcacggccgttttccgttaaaaaagaagaagcccactgcaaggcttcatacacttttatgttcctttccatcagccattcacactctccagtttttttgactggtcttcaaggataagggcatcaatgatttcatcgagtttgccatcaagcacctggtcaagcttttggatcgttaacccgatcctgtggtccgtcacacggttttgcggaaaattgtacgtacggatccgctcggaacggtcccccgttccaacggcggatttccgattggcatcatattccgcttgcgcttcctgctgaaatttatcataaatgcgggcacgtagcactttcatcgctttttctttatttttgatctgcgatttttcatcctggcaggacacgacaatcccggtcggaatatgggttaggcgcacagctgacatcgttgtgttgacgctttgcccgcccggcccgcttgatgcaaacgtatcaacccggatatctttctcattgatatccacttcgacttcctccgcttccggcaaaaccgcaaccgttgccgtagacgtatggatacgcccgcccgattccgtttccggcactcgctgcacccggtgagccccgttttcaaacttcaatttcgaatacgcgcccttgccattcaccataaacacaatttctttgtacccgccgatccccgtgacattggcttcaatcacatcgattttccagccttgtgattcggcataacgcgtgtacatgcggtacaggtcgcctgcaaacaacgcggcctcatccccgccggctgccccgcggatttccacaattacgtttttttcgtcattcgggtctttcggcagaagcaaaattttcaggcgctcttcatattccgggatttttgactcgagctcatggatctcttctttcaccatgtccttcatttcaggatcgagtttttccgaaagaagcgactttgcatcctggagctgtttctgcacttctttatattcacggtacacctgcacggtttcctgtaaatccgactgctccttcgaatactcccgcagttttttcggatcattgacgatctcaggatcacttaacaactcgttcagcttttcgtaccggtcttccacggcctgcaaccgatcgaacatcgaaccccacctcatttcacaacgtattcccgttccgataacagcaaaatccgccctcagacataacaaatttattatagtatacgcacggggaaacttaaagcggaacatgaaaacagctgctgaaatgcctttttccgggatgatttcctatttcacgtctattcggacatgaatgttgtagcggggcgccactttcaaaagctggctgcggatgtccgctgcttttttcattctttccctgtggttcagctgttcctccgtgtgaacattgacccacatatctttcccgttcacatataccgaatgggggacggcactgtccattttccaaaccgcttcccgtaccctctcgatatccgcgtttacagcggctgccccgccagcatccccgtttctttgcccggccttttgcgtatccgccgtgcttaacggcctcgtttcaacacgatccggcgcagcttcacgggtccggttttgggccgtgcaacctgctaagagcagcatggccaggcagaggaaaatcagctgttttgccataaaaaaaacctccttttccagtaggtttcccttcggacggaggtttatttacgaaccacgtaccgtcacagcggcggatggtcgtggcatttgcggcaaacaggataatacgtgtcgttcccgccgatctggatctggtcccctgtatacaccggcttcccgttctcgtcgacgcgcaaattcatcgtcgccttccgctcgcaaaaccagcagatcgttttcatttcttcgattttatccgcatacaaaagcatgtatttactgccctcaaaaagttcattttgaaaatcatttttaaggccgaatcccattaccgggatatgcaaatcatcgacaatgcgggcaagctgcagcacatgtctttttttcaaaaactggacttcatcgatcaggacgcagtatggcgggggattgtaccctttcaccatttcaaaaatatccgtatcatcgtagatcgggatcgccttcctgcgcaaaccgattctgcttgaaatatagccttcttcatcgcgcgtatcgatacccgatgtaaagatgaggaccggtttattctgttcttcatagttatgggcaactttcaatatttcaatcgatttgccgctgttcattgcgccgtatctgaaaaatagctgtgccatcgttcccgctccttatttcaacaaatatggttttaggatcagaaaaatccgtccggtcaaccggaatcccataaaaaaaacaggcaaacgcatcgcctgtttttcatggattcttttatttaagtccgtattttttattaaagcgatcaacacgtccgtcagcagtcgcgaatttttggcgtcctgtatagaatggatggcattcggaacatacttccacgcgcagttcatcttttacagaaccactttcgaattcgttgccgcacgcacatttgaccattacttttttgtattccggatgaattcctggtttcatgcttttcatctccttcagccctgagtcattgcgaaacagagttctattgttttacgggacacgccctgtaaaatttcataaacacactgtcattattatagcaagtccggagtggaaatgcaacatcactgcctgaaaaaagttcttccttatttttccttatattacacgcctggatgatgatactttcaagtctgctttgatcatttccacaaactcgtcgtttgttttggattgttttagcttgcgcaagaatttttcgacaaaatccggagaatcggacatcgatttgcggatcgcccacagcacttcgagatggtctttcgaaagcagcagttcttctttccttgtaccggaacggcggatgtcgatggccgggaaaacgcgcttttcggcgagggagcggtcaagatggagctccatgttcccggtgcctttaaattcttcatagatcacatcatccatacgtgacccggtatcgaccagcgcggtggccaaaattgtcaggctgccgccttcttcaatattacgcgccgccccgaaaaaccgtttcggacgatggaacgcagccgggtcaatcccgcctgaaagcgttctcccactcggcggaatcacaaggttataggcacgtgcgaggcgcgtaatgctgtccattaaaatgacgacatcgcgtttatgctcgacaaggcgcatcgctctttccaatacgagttccgcaaccttgatatggttttccggcacttcgtcaaaggtcgagctgacgacatccgcatgcacggaacgttcaatatctgttacttcttccggccgttcatcaatcaacagaacgatcaattccgcatcaggatggttcacggtaatagagttggcaatttctttcagcagcatcgttttaccggctttcggcggcgccacaatcaaaccgcgctgcccgaaaccaaccggggtgattaaatccataatccgggtggacagtttttcgggaaccgtttcaaggataatctgccggttcggataaagcggcgtcagagccggaaaatgaacccgttccttagcggtttccgggttttggccgtttaccgcttccacatgcagcaagccgtaatagcgttcgttttctttcggcggccggactttgccggaaaccttatcgccgtttcttaaatcaaagcggcggatttgcgaagcagaaatataaatgtcctccgaacttggggagtagttgatcgggcgcaggaatccgaatccttccgactggatgatttcgagcacgccttccataaagaaatacccttcttgctctgcccgtgcttttaaaatcgcaaaaattaactcttttttcgtcagtttgctatagtaggatactttatactctcttgcaagggcataaagctcttttaacgtcatattttccagacttgatattgataaactttccataaaaacaccacactttttcaatttacagtcgggtagagcagtctgtttcttccgttacatcaaaattttccatttgttcccggcgcttaaaactataccggtataccaatggaacagaacaggctaaaaataaaggaatgtgaaggcaagatatgaacatccacagttttgctttgcgcatagatagaaaacatgagctgtctgcaaagaggcaatgttgcagcacgtgcatctatggagccgcaccatgtacggaagaaaaagaagacaaacaattgaatatttataaataaaatcataatcattttaaccctgaaacagaagagaaatcaactaaaaatagcataagaggtaaaaaactttgttgaaaatgggagggaaggcggcacttccgcccttcccccgccgctatagctgcatggtcccccggagatttacgctttgatcacaaggttcggctttttcttcagactgtgctgcccttcaataaagcggaccgtccccgactttgcacgcatgacgacagaatgggtggatccgtactggcccttaaattggacaccgcgcaaaagttccccgtcggttacgccggtcgcagcaaaaatggcgtcatccccgctcacaaggtcgtccatcatcagcactttattgatgtcaacccccatgctcaggcagcgttcttgctccgcgtcgttttgcggcagaaggcgtccctggatctcgccgccgaggcatttcagcgcaactgctgaaataaccccttccggcgcgccgcccgatccgaacaaaatatctacaccggtatggtcgaatgccgtgttaatggcagctgccacatccccgtcattgatcagtttgatccgggcgcctgcagcacggagctgcgcaataatttcttcatggcgcggacggttcagaactgttgccaccacatcctcgatatctttattttttgcctttgccacagcttttaaattatcgataatcggcgcattaatatcaatcatgccgactgcttcagggccgacagcaattttatccatgtacatatccggcgcatggagcaaatgtccgtgatctgctatcgccagcacactgagcgcattccagccgccggatgcaagaatattcgttccttccagcgggtcaactgcaatgtcaacgcgggggccgtatccgttcccgagtttttccccgatgtacagcattggtgcttcatccatttccccttcaccaatgacgacagtgcctttcatcggaatggtgtcgaacacatcacgcatcgcggacgttgccgcatcatccgcttcatctttcaatccgcgccccatccatcttgcggatgcaagtgctgcagcttccgtgacgcgaaccaattccattgacaaacttctttccaatttcactacccccataaatagatttttaattagtatatcacatttaaaaaattattgtgtcataatttctctgtttttttctatttatgggggagccggcagttgttcgctaggaatggttcaggtgttccatctccttttcggacatgccttcccgccaaacagcagcaccaagtccggttagtttttccacgaggcagctgtatccgcggtcgatatgttcaacgcctgtcacttctgtcacgccttctgccatcaggccggcaatgacaagggcagcacccgcacgcaaatcactcgctttcacctttgccccttgaagccggaccggaccgtttacaatcgcagaccgtccttccactttaatattggcgctcattctccgcaactcgtcaatatgtttaaagcgggcggaatagattgtatcggttacgatggacgtcccttctgctcttgtcagaagcgtggtgaacggttgttgcagatctgtcggaaaccccggataaacgagcgttttaatatcaacgggtttcagcttgtctgctttcccgataaaaatctgttcatccccggtttccacaggtatgcccatttccctgagctttgcggtcagcgactcgagatgatgcggaatgacattgtcaacaagtactccttcacccgcggccgccgccaggatcataaacgtaccggcttcgatcctgtccggaataatcgtatgccggcagccgctcaaatgatctacgccttcaatccggatgacatctgttccggcgcctttaatttttgcgcccatatttgtcaaaagtgtggctacgtcaatgatttccggctcttttgcagcgttttcaatgattgtccttccctttgctttaacggcagccagcataatattgatcgttgccccgacactgacaacgtccagataaatacgggcacctttcaattcatccgcccttaaatagatggcaccctgctcatttgtcacttttgcgcccaatgcttcaaaacctttaatatgctggtcgatcggccgcggtccgagatggcacccgcccggcagcccgatgacagcttttttgaacctgccgagcatcgcgcccattaaatagtatgaggcacgcagtttcttcaccctgccattgggcagcggcatcgagatcatatggcggggatcgaccgtaatttccccgtcctctgacgtaaccgttgccccgatctcttccagcaggccggtcaatgtccggacatcggaaatttcaggcaagccttctattgttacaggagattccgcgaggatggtagcaggtattaaagcgacagcgctgttttttgcgccgctcactttaatggtgcctttcaaaggatatcccccggcaatttttagcttttccatattaagctcccttctttagcgggtatggatgtacattccggctgtaaatggccgtttcgcaaactgagtccgaaagccccgaaaaaacaatatgaatcccagcaacaggattgccgaacaggcggaaaatcaaactgtcccggagaaagcaagaaataaagagcaattttaaatatttccgttattttgctgtacggctgttccagtcgcgtgtaaattgttcaatccctttgtccgttaatggatgcttgaacagctgtgtgagcactttaaacgggacggttgcgatatgcgcccctgcgagcgccgcttgtgtaatatgttgcgggtggcggatcgaagctgcgataatttccgtatcaatttgatggatggaaaaaatttcggcaatctcggaaatcaggtggatgccgtcatgaccgatatcatccagcctgccaaggaacggcgaaacatacgttgcacccgctcttgccgccaaaagcgcctgattgctgctgaaaaccaaggtaacatttgtgcggatgcctgcctgtgccaattgatgaacggctttcattccttccggcgtcatcggcactttgactgtaatattcggagcaatagccgccagttcctttccttctttcaccataccttccgcatcttcggaaacgacttcagcactgacagaaccaggcacgagcgccgtaatttcttttaaccggtcatggaatgaaacattttcctttgccacaagcgacggatttgtcgttacaccggacaaaatcccccattcatttgcggttttgatttcctcgaaattggcagtatcaataaaaaatttcattctgcttccatctccttttatggttcctatgtatccatttccactataccacggaacgaaaagaaagttcagaaaaacaaccgtttttttcactggtgcctatccaaaaaacgactataaaccctcttgtttcgggcgtttgaacctgtttcccaaaaaaggcacaaatgtaaagcgcttaaaaaacccgcattttaaaacaccataccaaaaaagcccggcacgcacggggcagcgccagaccttttttatcttgaacactcatccttaaggcatgcgtgttctcggctaatctaaaacgatcatgctttttggttagaaccgaactcgcggattttgccgataacggtttgtttaatcgtttcgcgtgcaggcccgaggtatttgcgcggatcgtatacatccggatcagctgccaatacttcacgaaccgttttcgcggaagcaatttggttttccgtattcacgttgattttcgcagtacctaaagaaatagcttttttaatatcagcttcagggatgcctgtcccgccgtgaagtacaagcggcatgccggtaattttgctgatttcttccatttctttgaagccaaggtttggttcgccgtggtaagggccgtgaaccgaaccaagagccggtgctaaagcgtcgattttggtcgcgtcaaccagctttttacattcttcaggatccgcataaatgatgccttttccgacaacatcgtcttcctggccgccgacagtgccgagttctgcttccacagatacgccgtgggcatgcgcatattccaccactttagaagtaatttccacgttttcatcaaacggatggtgggaagcgtcgatcattacagaagtaaagcctgcatcaatggctttctttgcattttcaaagcttgaaccgtggtcaagatggatcgcgaccggaaccgtaacattcaagtcttccattaaaccttcaaccatttttacaacggttttaaaaccgctcatgtaacggcctgctccttcggaaacaccgaggatgaccggggatttttcttcttctgcagccatcagaatggcctgggcgtattcaaggttattgacgttgaattgccctaccgcatatttcccttcttttgctttattcagcatttcagtcatggaaactaaaggcatgaattttcctccttatcatttgcgttaaaaagattgcccgaggttatcatttttatgatatacaatcttcataacatcatactagcctattgatcattccttaacaatcataacaaacaaaaccggcatttaccaatgaactttatttgtcggtaaaaagaaataaaattatcaaaattttacggtttagcacttttttcacttcatgcgcttacattgccaaatattttttcactgccttgcggatgtcgtcaatatcaaacggctttgcaaaatgggtcagtgccccgagctccttcgctttctcaatcaagtccagttcgccgtaagcggtcataatgatggcccggatatccggtttcatttctttcagcttttttaaaatttcaatgccgtccatgccggggattttcatatccagcaagacaaggtcgatttcatggtttgcagccagcgaaagtgcctgggggccgtttgccgcctgaaaggtttcgtagccctctttctgcagcacttccgtaagcaaaacccggatgccaaattggtcgtcaacaattaaaatattcggctctctcatttttctcctccatcagctgatcagttttaacaaaatttgtatgtatttttgcctagcaatgcccacttgctttatgtatgttaaactatttctacttctcgttccttttttcctgcttatacaagtggcaaattgaatgatcatagacggaggcggaaaagcagcaaaaaaataaaaggggaaggccccttttattctatcgtcaactcaaccccttccacataccgggggttaattcgttttcctttttgaaccacttttccactgtacagctgcttgccgcttgaaatgtcaaacacatacaggagacacgctttttcccgggaatcgttcgggataaggaagtacaacctgccgtttttgatttcagggatggggttgcccgtactctggtacttgatagcaaatgtcttatctgctttcagctttccattcccgtcaaaggttaaaaggcgcgcgcctccgttctttttttcggttgccatataaactgcctttccgttgtaaacagatttccaatcatcgcggtttcgtagcggaatgtttatcggtggcttgagttttttcgtttcatttgtgcaatatttgtaaataaaggtattcacttcctttactgaaccgtcaccgtccactttctcttcttgatatgccagtatatggttgggcttgttcacgtcggtttctgcgagctgggtatattgagccattctccccgtctgtcctctttgtgtaatccatttgcctccggttattttcttgtccggcaggctgacacgatatacgcggatatctccatctgtggctgccgctactttcagctcatttccagttttttgcacatcccaaaccgatggaaaagattgttttgaaaaaccttgcaccttcctcttcattgtttctgtttttcttgttttcttatccagcacctcgacatacagttctttatcgaaccggtgaagcggctgcggaatgatgtccgcataagcaatcatttgtctatcctcataaaagccgccatgattggtctttcccctcataaatcggggatactgcttgacatactgcttgtaccaatccgggtcttcatctagtagcgaaaaagaagattcccttcctaaatagcggcttccagatgaagtaatcgaaaacatgcgattcaaatggttttcctggttatccagagcagtgattttaacatttcggatttctttttcatttccgcttatctttttcagcataagccccggatccttgtcagcggccaatgcggtgtaaaaaaagggaatcgccgccacaaccgcaaccacaatcaccaataaatttatatagcgtctcatcgtatctctcccttacaccgttactttgtatttgatcaagtatccccccagcaggatggaataccccgcgatgatggcagtcatggccacttcaatccataacaattccgattggtacaaaacaccgggcagcaatatatcaaagaggaaatccggcgtccaaaataaaacgaacgagagaaagccgaaaagcaggccgagcaagacccccttcatgcggaaacttctttccaataagatggccgtaaagatcacaaggaccactgtaaaccctaacccgtaatgtaagagaaagtctatcactgtactaggaaggagcaggttaaacaagggaaaacttaagacagcatctatgaccgtcatatccatcctgtaaatgcccggtgtaatagcattaaaaaagaaatgttcaaccggcagcaaaacaatctgaacagcaacaaatccaaacaccatcagcaaaatgcttgccgctttcgccaaatagagattccatctttcaacaggaagcatcaaaagccggtatataaacgtatgcttaccgtaccagtccctgtaccaaatcaggaatatataaaacatcatggccgccgcacaaagcgcaatcggccccatgaaccaaatcgaaccaaagcagtcgataaagccgatcgaaccataatgctttacgtatgccagctttggcagtgactgatgatacatgatctcatttgctttagtgatgtaacgatgcaccgtcaaaaaaacggccgtaaattgtgaaaggatggtgattgcaaccaaagaccagtagattttcgcaaaacggttgatttcgaagttgacgagttttacaaaacttttcattgccggtatacctccctcattatatcgacaacggatttcccttcgctttggcgaatgtcttccgtgtaaaattcttttaaaaccttcccgtccccgagcagcaccactttgtccaatagatgctcaatatcgttgatttcatgtgtggtaatcaacaccccgcggttttcaaccaggccgcttgcgaacacatctgcaatttgttcccggctgaaaatatcaatgcccgaaaaaggttcatccatcagcacataatcgacatcgagcgatagcccaagcagcaaattcacttttgccatgtttcctttcgaaaggtcaccgatccggtcattttcattcagtttgaaaaaataaagcaagtcttttgcgcgcaatgcattccagtccggataataatctcgcataaaaagaatggcatctttgattttcatccgcggcagcatgatgggcgcatccggaatgaatgccagcttctcgtaaatatgtttgttgtacggttccccgtcgatcagaatctttcctttgctgaccgggacaagccctgcaatcgcttttaaagtggttgttttgcctgtcccgttcaccccgatcaaacaggtaatttcccctttttctgctgtaaaagaaagcgaatcaagcactttttttcgcccgtattttttcgtaacttccataacttcaatcatgcccggccccccttttgcccgcggtattgcctttttaccagctccaatagctcctccagcggaatgtccatcgggcggatcgcatccagaaaatcagccaatgctgactggatcagttcttcccgtacccgggcaagcacttcccggtctgttgtaatccggctcggaagattgcgttctgtgtggatcaaaccttgctcctccatttctttatacgctctttgcgcggtattcggattgatttttaacatggctgcaagttcgcgccgcgatggaatttcctgtcccgcctcaaggctccctgacgcaatccgggttttaaaatagtggataacctggatgtagacaggatcgcggttattccatttaatctctgcgatgatctgaatcgcccccatcctttttcatctctccatgtgtatgaagggcttcatacacgaacgtcaaaatgatcgtattaatacattcatacagctgatatgtgtatcatatcgttcatacacttctccgtcaatggttttttataaaaaacccgaaaaaaattccgggcttttgtatgaaaaaaaacgggatgcaaaaaagcggtgagaaaccaagcataatggtctctcaccgcttttttcatttaggtgcctttggaaaaatggagcacttccaaagggacgagtttattgtttccccttgatcgacgcttcgataaaccctttaaacaaaggctgcgggcgtgtcgggcgcgaggtaaattccgggtggaactgggaagcaacgaaccacggatggtccttcagctcgacaatttcaatgagccggccgtccgggcttgtccctgagaacgtgaacccggcattttccatctgttcacggaattgattgttaaattcataacggtggcggtggcgctcataaatgacttcatcctgataagcttcatacgctttcgtacctttcacaagccggcaaggataaagcccgaggcgaagcgtaccgccgaggtcttcaatttctttttgctccggcaaaaggtcaatcaccggataaggcgtatccgggttgatctccgaggagtgcgcatctttcaaaccgaggacatggcgggcaaattcgaccgatgcaagctgcataccaaggcagatgccgagaaacggaatcttgtgttcacgggcatactggatggcaagaattttcccttcgatgccgcgatcgccgaaaccgcccggcactaatatgccgtccgcatctttcagcagatccgccacattttccctgtccacctcttcggcattgatcatgtcaatatcaatatctgcatcaaactggtagccggcatgtttgagcgcttctgcaacggaaagataggcatcctggagtgccacatatttgccgacaagcgcaatttttaccgtctttttcagattgcgcacccggtcaacaagccctctccattcggccatatctgcttccgggcactgcagttttaaatggtcgcaaacaagctggtccagtttttgttcctgcagcatgagcggaatggcatataacgtatcggcatcgatgcattcgaccacttcgcgcggctggatatcgcagaacaatgcaatcttgtccttcatatcctgggagatcggcatttccgtccggacgacaatgacatttggctggattccgaggccgcgcaattcttttacactatgctgggtcggcttcgtcttcatttcgcccgatgcttttaaataaggaattaatgtacaatggatatacatgacattgtcaatgccgacatccgttttgatttgccggattgcttcaaggaacggaagcgattcaatatcaccgaccgtcccgccgatttcggtgatgacgacatctgcattggttacttttccagcacgaaagacacgttctttgatttcattggtaatatgcgggatgacctgtacggtgccgccgagatattcgccgcgtcgttctttccggatgacttcggaataaactttaccggtcgtgacgctgctgtattttgttaagttaatgtcaataaaacgttcataatggccgaggtcaaggtcggtttccgcgccgtcgtccgttacaaacacttccccgtgctggtacgggctcatcgtccccggatcaacattaatatacgggtcaaatttctggatcgtaatattcaacccgcggttttttaacaaccgcccgagcgatgccgcagtaatcccttttcccagcgaggaaacgaccccgcctgttacaaagatatattttgtcacgtgttgtcccctcctgtaatgtaacattattgttgccccaatacacggcttcatccatttttaagggcttgggtctggtatgaatcgttttttaaatcagtcctgtaaaaaacaaaaagcccctcttgcaatacgggttgcaagggggagcttgatttattttgcgatattccgtccttttcaaaggagcccaaacataatactaccgttgtcctggaaagaagtcaagactaatctttgtcgttagcgtcttcctcttcttcgtcttcagtaatgtcgaaatcatccgtgagcagttcatcgtcttcgaaagtttcatcatcatcttcatcttcatcgatatcagaaaactcatcgtcagccaaatcttcgtcttcggccaaatcttcatcttcctcgtcttcgtcggcaaaatcctcatcatcatcttcgacgacatcatcgatatcctcaagatcgaggtcctcatcatcaataatgtcctcttcttcctcgacaactttcgcttttttccgcttcgtttttgttttcacggtgtgggtcacttcttcgtcaatctggtcaaccgggtaccaggcgcggagaccccaagtgttgtcccccaggctgataaatctcccgtcaatgtttaagtccgtatagaactggatcatttttctttcggtctcttcttccggcaatcctaaaaccgcgccgatttccgcaagcaagtcctggaaggaagtcacttgtttcttttcctccaatatttgttccgccaactcgataaaagacatttccttcagttcttctttcggcaactgtcgcaagctcacgcgtcgcacaccctttctcattgatcaaaactgctatatggcaggcaaatgctaatctttgcatgatttaatagaaaacatatttaccattatatacaaaaagcaaacgtttatgctagccccgcggccttttccggctttttttatcccggatttttaagcggcccggtgtcctcatcagccggtatgcaagataaaacagaaaaaaagagaggattaaaaaagggatggcaccaagttctttactgtataaataatacccagccagcaaaaaaacgatcataccgctgcatgatagtaaaattttgatgaaagaaaacaaacagtccacatcccttgaaaaaataagcgattgacgagtcctactcccaccttccgcctattcaagcacatctcctatatccttgttcattttacatccatctggtagaaagaaacaacagaattctatgtggaaagaaaatttattttcgtacttgccattgagcgaaagcaaaaaaccggcattcagctgccggttttttgcttttggaagcacacgctgcatttttgtccagcggcaactcctagcggaaaatgctatttgggtcgttcagctttgctggcactgtagttttagctgtatcagtatccaacttatcctttgttggcccggtaacgtttgcaacaatactaaaagaatggccagaacgcttggcacctgcttcagtcggaatatataatgctaatatcaatattgtcggtatgagtaaactcacattataattggaatattatgttaaacagattcttttttaaaaagttccatcattatcaatatactggaaacttcaaaattcagagagtagttttacttctcccattttgccagccattcacaaaaaatggcaaccactatgccgcgaggagatctcttctatgaataatgacttacgatgcagatccatacctaaaatgaccatatgaatacatagctcaaaaatattatcgtttttattgaaggagaatattatggaagcattaatagaagctaatcgaatttgtaaaagatataatcaaaagagcagtaacatggaattgaaagaaacatcccttaccattcaaaaaggaaagatttatgtcattgaagggaaaagtggagcagggaaatcaaccttgttaaatattctgggaggaatggagaaacccacatctggaaaagtatattacaaaggaaaatccttttatgatctaaaggattcggaacaggctgctattagaggagaacaatacggatttatattccaatcttttcaacttattccggaattgactgtaaaagaaaatatagaacttccactcatgtttataaataggcatgaaagaacaaataaagtggaagaattagctggatatttagggattgaaaatcaattacataagcttcctgactttttatcaggaggggaacaacaaagagtagccattgcccgggcacttattactgatcccgaaattatatttgccgatgagcccaccggtaatcttgatggagaaacaaccaaaaaaatgatccatttattcacaagtctgtgtaacaaaaaaaatataacactgattgttgtcactcacgaaaagaatttattcgaatttccagatactttgtttcttatgaaaaacgggagattgcaggtgatacaagaaaatgtttaatttaagcatgaaaattcttttatcgcgaaaaaaatggttatttctcatcgctggttcaattgccattgttctatcatccgtagcttctatatttattggttctgaatctgtaagatcagcaattaaacaaaaggctcagaatacttacggagaacataccggtgtgttaacaaatattacagaaacaaaaaaatcattgttgaagagaaataaggggatatcggtaggagtatatcaaattattggtaaaactaaaattagtagtgatagatttgcaacggtgggctggatggataaaaaatcaatattattgggacatttaaaattaataagtgggagatttccggagaagccaaatgaggttgcgatagaatctgcgtatttacaaggccctttaaaaaattggagaatcgcggaaaaaagaacaatcaaaattggaaacagcacgaaaagcttacgccttgttggaatagtaaaaaattattcatcacaatggtcagtagccgaggattttgagaagggtgtcaatgacttcccgaatatatttatatctaaacagttaactaccaattataagaaaaataatagttttttgttcaaatataacggaagcacaaaagattcgtttgaaaaatcaatagatcttattaatcactatgaccaacaaggcactgttaatagtcgattatttaataacggactaaatcaatgtgatacgatcaggaccttatcgattacatttcaattattaattgtgattctttcactattttctataaacagtctcattttatattttacccaagatcaacataaaaaattgggtattatgaaatccgtaggtgcaagtcaacgagctttataccgcatatacatttaccaagctgttattatttttgttttaagtgccttattttcatttcctatagtatattctattcagtcactaatcattcatttctcatacagagagtatttttctaactttatgctgatgattgaaatggttggaatgagtatattactatacattggattattctttatgatcttatttttattccttaaaaatgttaaggagtccggcacattacatgtacaagaactattgaaccagcaaaatcgtgtaagtttcagcgaacgatataaaagcgtttttaaaggctttcattctagctatggaaaattattagtgaaagaattattttcaaatccgaagcaattctaccttactgtattaattttatgcttttcatctttaacattcacatttacaaattatattcaaaaagataatttgtatggttgggaagggcttaaatccaagtattatttaaactcccaagaagcttttagctttaaaacacaacaaaatttaaaagtattaagtcaccagggattaacctttacagaagctgaagtaaaaaaactggaaaaaacacccggggttttatacatagataaaactccattcatggaagatgtcgaaacgctaattgatcggaaaatgattacaccttccattaacaattggatctttaatgaaaactctgcttataaaacttataataataaaattattattccggatgtaaaatacgttcttctcaataaagacgactggaaaaatattgaggctccaaagaaatataaagatcttgatggcaaagcattcatttataatccagttaacaagaaaaacacaaacgaggataaaatcttagttggaaatacattgactttagtcagattgtataaaacgccaaccggaatgaaaaccagtcaaaaaaagttaaaaattctagatgttattcataaaccatttaaatatagagtcagcccttctgtagaaataaaaaaagatgactttattattttgatggacactcaaaccgcagtaaaatccggtttgttccatgggtttaatgaacttgagatttacacgaaaaaagatatctctcataaagaaaaaatgaatcttgataaacaagtaaaatccttatcgtcaacatttcctggcagcttagtgcagaatacttctcaattaataaaagacgataataaaatttataattatctcaaggtgcttggcatgcttttgttttttgtctctcttatcctcactgcgatttccgtcacgatcatgatctttagcaaatatcaaactcagaagagacagtggggcatttacttatctcttgggatgagtaaaagaaacatcatgcaactcgtttttagcgaaatattcatttatgtttttgtctctatgattttaagtatgttaatttgttgtattggattgataatgttaccgcgtcagtatccccttgttttctattttaaatattttctgttgtctattttaattgaaatcagttttctcattatcgggggctatataataaatcgttccttacaacgtcaatcaattgcttctttccttagaagggatgagtaacacgccttggacataaataaagaagcgaaaagctatcgtgatatgatgcaatagcttttcgcttctctttcttttttctaattcattcgcaatatgaatagaacgcgtgtataatcgaaatttttgccagttttttaagaacaatacttcttgcagccggctcctcggatagcataacctgcccgtaataaagcccttagcttattccggccagaacatttgcctgtcggatacgggcaaggcggcgggactttctgttcacatattccttctgtattgcccgccaatttggtagagggtgttggtgatttggccgaggcttgcgactttgacggtttccataagctcggcgaaaatattgcctcctgaaaccgcggtttgctttaatttttccagtgcggtttccgcttctgctttgtggcgggcctggaaatcacgcaaatttttgatctgcaaatctttttcttcctttgttgcccgcgcaagctgcatattgttcagctcgtcctcgcttttcgggtttggattcaggaaggtgttgacgccgataatcggaagggcgccggaatgctttctgacctcgtattccatggactcttcctgaattttccctctctgatactgggtctccattgcgccgagtaccccgccgcggtcattgatacgctcaaattcctccaaaacggcggcttcgacaaggtctgtcagttcttcaatgataaatgaaccttgcagcggattttcatttttcgacaatccgtgctcttttgtaataatcagctgaatcgccatcgcgcggcgcaccgattcctcggtcggtgtcgtaatcgcttcatcatatgcattggtatggagcgaattgcaatgatcctgaagggccatcagcgcctgcagcgtcgtgcggatatcattgaaatcaatttcctgtgcatggagcgaccggccggatgtctgaacatggtacttcagcttctggctccgctcatttgccccgtataaatcgcgcatcacaaccgcccagattcttcttgcaacacgcccgatcaccgtatattccggatcaagcccgttcgagaaaaagaatgaaaggttcggggcaaaatcatccaccttcatgccccttcctaaataatactccacatatgtgaaaccgtttgcaagtgtgaacgcaagctgtgaaattggattcgcacccgcttctgcgatatggtatccggaaatcgagaccgaataataattgcgcactttatggtcaataaaatactgttggatatcacccatcatccggagtgcaaattcagttgagaaaatgcatgtattctggccctggtcttcttttaaaatatccgcctgcacggtgcccctgaccgtctgcagcgttttttcgcgcacctccgtaaattcctcgacggttaaaacgcgcccgagctccgcttctttctttttcacctgctggtcaattgccgtattcatgaacattgccagaatgaccggcgccgggccgttaatcgtcatggaaacagaagtcgaaggcgcacaaaggtcgaaccctgcatacagttttttcatatcatcgagcgtgcacacacttacccctgactcgccgacttttccgtaaatatccgggcgttcgtccggatcttcgccgtacagcgttaccgagtcaaaagccgtgctcagccgctttgccggatcatcttttgataaataatggaagcgccggtttgtccgttccggtgtcccttcccccgcaaactgccgcttcggatcttcttcctgtcgcttaaatgggaaaacaccggccgtaaaaggaaatgcccctggcacattttctttatacagccattttaaaatctcgcccttgtcttcccaatctggcagcgccactttcgggatcggaagcccggacaagcttgttgtcctgatcctcgttgtgatctctttattgcggattttgacagtgaccgtctccccgctgtatttttgcttaacatccggccagcttttcaaaagggttttcgattcttctgtcagccctttttccgcttccgtacgaagcgcttcaagcgatgtaatcacatcctctgctgccccggactcctttgcggccgtaatggcgccttcaagttgaaacattctccgtgcgagcattgcctgtgcctccgcctttttatggtaccggcggacggtttccactatttcccgcaagtaatggctgcggcttgccgggatgatggtatgccggttgcccgcttcctgctttttcgaaaaagacgagcgaaaagccgtaccgctcttttcattgattttttccatcagggcgccatataaggcgtttgtccccggatcatggaactggctggcaatcgtaccgtataccggcatctcatccaggctttggtcaaacagcagatgactccgctggtactgcttttgcacctgctttttcgcatcctctgaacctttccgctcgaatttgttgatcacaataaggtccgcataatcgatcatatcaattttttcaagctgggaaggcgctccgaattcgctcgtcatcacatacatggcgacatcggaaatattcgtaatttcggcgtctccctggccgatcccgcttgtttcgatcaaaattaaatcaaagccggcagcctttacaatccggatggcgtcatggatggcaagggaaagttcggaacgggaggccctcgtagccatgctccgcataaaaacgttcggatggaaaattgcattcatccggatcctgtcgccaagcaatgcgccccccgttttttgcttcgtcggatcgaccgaaagaacggcaattttgctttccggatggtcgtgcaaaaaacggcgaatcagttcatctgtcaaggagctctttcccgctcccccggtaccggttatgcccacgaccggcgctttcttcacagccgacaccgcagcttcaagggcagcgagcgcttcctgatggttcaaatggttctcggcataagaaatcagcctggcaacagaaccgatccgcccttcgcttaagcgctccacctcttttacaaaatccgcttccgttaccgtcgggtggtcgcactcccggagcatgatattgatcatcccctgaaggccgagctttctgccgtcctccggtgaaaaaatccgcgcgatcccgtagtcatgcagttctttcatctcacgcgggatgatgacgcctccgcccccgccgtaaatacggattccggaggcgccattttcctggagcaaatcatacatatacttgaaaaactcgagatgccctccctggtaagaagaaacggcaatgccttggacatcttcctgaatcgccgcctggacaatttcgcgtgccgagcgattgtgaccgagatgaatgacttccgcaccgcttgcctgcaaaatcctccgcataatgttgatggaagcatcgtgaccgtcaaacaaactggacgctgtgacaaaacggaccgcatgtttcgggcggtaaatttctgtatcagccatcatatcctccttgtcttcatcaggattaagttaaaacgcataaatgaaccccgggatggaaaaatttatgccatcatatcccttgtctcaaggccggaaaacagcaaatgggtttgcagacggatataatcctcaattgtaaacttctttttaaatgcccagcggcggaaagcccacatttcaccctggacaaaaatattgtgggcgagcatctccatctctttttcatccagatcaagttcaccgttttccgcgcattttctgatcattttttcaaatatgccaaccatctccatttcctttttcaatacatatggcagtgcttcttttgtcagtgactttgcttcctggtacatgacaagcacttcatcttgcagttcgtcaacaatccggaaataatgggcaatcgcgagtttcaaactttcaagcgtcccctgaccggcatcaatgcgaatcagcctgtcgcgcacttcatcataaatccggtcgcacaccaaatagaggacatcctcttttgcccggatatattcataaagcgtcccgatgctaaagccggatttcttggcaatttccctcgttgtcgtccggtggaaccccttttccttaaaaagcgctacggcggcattgatcatttggtttctgcgcttttcaatcagcctttcatccctgaccgatgccggcacaaactttttttggctcacaaacggcctcccctctccgtcagtcctttgtcagcattcttgaaataacaagccgctggatttcctgcgtcccttcgtaaatttgcgtaattttggcatcgcgcatgaaccgctcaaccggataatcttttgtatagccgtagccgccaaaaatctgcacggcttccgttgtgactttcattgctgtatcgccggcaaacagtttggacatagcggattcttttccgtacggcagcccgtttgattcaagccatgccgcctggtacgttaacagccttgccgcttcgactgcagtggccatatcggcaagtttgaaagacacgccctggttcgctgcgatcggtttgccgaattgtttccgctctttcgcataagctgtagccgcatccagtgcgccttgggcaatgccgactgcctgggccgcaatgccgttacgcccgccgtccagcgtcatcatcgcgattttaaatccctgtccttcttccccgatccggttttctgccgggaccatgacattgtcaaaaatgatttccgttgtggtggaagcccggatgcccattttcttttcttttttgccggttgaaaacccgggaaaatctttttcaataataaacgcgcttgtaccatggtgtttgcttttcgggtcggtgagggcaaacacaatgtaaatatccgccacgccgccgtttgtaataaaaattttggagccgtttaaaacatagtggtcgccttcacgcctggccgttgtcaccatcgcgcctgcatcggaacccgaccccggctccgtcaagccgtacgcaccgattttttccccgcgggcaagcggaacgagatatttctgtttttgttcttctgtgccgaatttaaacagcggccagctggcaagggaagtatgtgcggaaagggtcacgccggttgaggcgcacacacgcgacagctcttccaccgcaatgcagtatgccagaaaatcgctcccgatcccgccgtactgctccggccatggaatcccgggcaggccgagcgccgccatccggtcaaagatgctacggtcaaaccgttcgttctcatcgcgttccgctgctgtcggtgccacttccttcacggcaaaatcgcgtaccattttccggatcatttcatgttcttcacttaaacgaaagtccatttttctgcctccaatttttttatccaagacaacttaaagccttttctcccgcaataattgattgctgatcacgattctttggatttcacttgtcccttcataaatttgcgtaattttcgcatcgcgcatgaaccgttcaaccggatagtctttcgtgtatccatatccgccgaaaatctgaacggcttcaatcgctgtatcaacagctgtttgggaagcgagcagtttggccatcgccgcttcttttttgcagcccaggccgttgctccgcaaaaaggctgaccggtagacaagcagtttgctggcttcgatgtttgttgccatgtcggcaagtttaaaaccggtaccctcaaatgcgtggatgggttttccgaactggcgccggttttttgcgtattgaagtgccagttcataggcgccttccgcaatcccgagggcctgtgccgcgatcccgatccggccggcatccagcaccgccatcgcgatcttaaatccttccccttcttcccccagccggttctcagccggaacctggagattttcaaagtgaagctggacagtttttgacccgtgaagccccatttttttctcatccttgccggtccggaaacccggcatggtcttttcaataatgaaagcggtgatgttgccgtcttccgtgcgggcaaatacaatatacgtatccgcctcgccgccgtttgtaatgaacatttttgaaccattgagcacataatgcccgccctgttttaccgcttttgtttttaaattcttcgcatccgaccccgcctcggcttccgtcaggcaaaaagcccccaggtattccccgcttgcaagctttggcaaatatttttgtttttgcgcttcacttccgaaatataaaatcggcgcggtcccgacggatgaatggacggaaaggatgacgccaatggtcgcgctggctttggaaatttcatgaacagctataacgtatgcagtaaaatccagccccgcaccgccgtatgtttccggaatggtgatgcccatcagaccgagggttgccatttttccaagtatttcacgcgggaacatgccgcgctccatgtcgcccgtagccggcaaaatttctttttctgcaaaatcccgtacggtttttcttaacaaaagctgttcttccgtaaactgaaaatccatgatcaggtccccttttttgggtggtcatacacgttgaagttttattgcacttcaatcatgacggcatcgccctggccgccaccggagcagatggctgcgatcccggtcccgccgccgcgccgtttcagttcgtatgcaagggttaaaataatgcgcgtgccgcttgcaccgatcggatggcctaacgcaaccgcgccgccgtttacattcaccttatccaaatcgagctgtgcgattttgctgctggcaagggccacagcggcaaatgcttcattgatttcaaacaaatcaatgtcatcaagctttcttcctgtttttttcaggatttcgttgatcacaagccccggcgtctgcggaaaatgctgcgcttccaccgccacttctgcatgcgccacaatatttgcgagcggtttcaatcctgcttttgcagcccgttcagcactcattaacacgagtgctgctgccccgtcattcacgcctggtgcattgccggccgtgatggtcccgtctttgtcaaaagcaggcggcagctgggacagtttttcaagcgtcgtatccgcgcgcggcggctcatcctgttcaacaagcagtgcaggaccttttctttgcgggatttctaccggaacaatttcttcggcaaacttgccggaatggatcgcttccaatgctttctggtggcttcttaatgcccagcggtcctgaaaatcacgggtcagcccaaacgtttctgccgtacggtttccgtatgtgcccatatggacgccggaaaatgcgcagatgagtccgtcatgggtcatcatgtctttcagctggacatcgcccattttcaatccccatctcgccttaggcaggaagtaaggggcgtttgacatcgactccatcccgccggctacgataacttccccgtctcccgcgcggatgatctggtccgccatggtcacgctcctcataccggaagcacacactttattcaccgtttccgttttaacttcccacggaatgccggcgtgccttgccgcctgccgggatgggagctgcccctggccgccctgcaggacattccccataatcacttcatctacttccccgttttcaacgcctgctttttccaatgcatgccggatcgcaatcccgcctaacgtagacgccggaagtgcagccagttttcccccgaatttcccaaatggcgtacgcgccccatcgatgatcaccgtgttcaaccaacttctccccttttacattggatttatgataagcgccggccatttgcgcgaacgctaatcatcgttcctttgccattcgttgccaaacagcagtgagccttgtcatgtttttggtatggataaagagcacctctgaatcgcgtaaatacgtaatcccctttctttgacttgctcttttgccatccctgccaatttgcagcgaacctcccgatgcttttagaatggatgaaaagcgcatcccaatcgagcgaacgctaatcatcgttcattcatcgttcctttgccattcgttgccaaacagcagtgagccttgtcatgtttttggtatgggtaaagagcacctctgaatcgcgtaaatgcgcgatcaccgttcattcacttattctttttccatgtacttccaaatttgcaacgaacctcccgatgcttttaggatgggtaaaaagtgcctcccaatcgagcgaacgctcaatcatcgtttaatcatggcccttttgccattcgctactaaaaacagcaataaagccttgttatactgcgtgatttatttaaaagcgccaaaaaacgtatgaacgcttatatctccaaaccactatcattctgtgtgatctgccgcaaaaaagcggcggagaacccacccaaacttttacatatcccgttccccgccgtttttgcgcagatgatttgccggtttaaaatctaccatgatctgcttttcctgccgagcatcccgttttgcggcggcatcacccgcttaagaaactgcagccgtctgccccggcgccccgcagaccgaacgttccagaatttcggcgacatccaaggtttttacagtgtcttccacttctttcgcttttgtgccatcagaaagcattgtcaagcagtacgggcattccgtgctgataacggtcggattcacagcaagtgcctgttccgtccgcgccacattaatccggtgcccggtatcttcttccgtccacattaatccgccgccagccccgcagcacatcgctgtttcacggttccgttccatttccacaagctttacgcccgggatcatttttaaaatgtcacgcggctggttataaatatcattgtacctgccgaggtagcaggaatcatggaaggtaaccgtttcattgacttcgtatttcggctttaagcgcccttctttcagcagctcgtaaagcacttcggtatgatggtacacttccccttcaaagccaaaatctttatattctttcttaaatgtattgtatgcatgcggatcgatcgtcacgatttttttcacgccgttcttttcaaactcggcgatgttctgaccggccagttcttggaataaaaactcattgccaagcctgcgtgccgtgtcaccggagtttttctccttgttgccgagaatggcgaatttcacgcccgcttcattcagcagtttcgcaaacgactgcgcgattttctggctgcggctgtcgtaagaccccattgatccgacccagaataaatattcgaatttctcatctgctttcttcatttctttgaccgtcttgacctcgatatcttcgcgcccttcacgccacgtttcgcgctctttccggttcagcccccaaggattgccctggcgttcgatattttgaatcgcccgctgtgcatccggcttcatttttccttccgtcaaaacgagatagcgccgcaaatcgatgatcttatcgacatgttcgttcataaccgggcactggtcttcgcaattccggcaagtcgtgcatgcccagatctcttcttctgttatgacatcgccgatcaggctcggattataatcgagtgctgcagctgcctcttccgccccgcgacttgcactttcccgggcgagccggtttcctgtcgtgttggcaaaagcaaatgccggaacccacggtgctttagacgtaacggccgcgccgtagttggtcaaatggtcccttaatttaatgatcaagtccatcggtgaaagcattttccctgttccggttgccgggcacatattcgtgcagcggccgcattccacacaggcgtaaagatcgacaagctgaagctgcgtgaagtcctctattttgccgacgccgaaactttcctgcgattcgtcttcaaaatcgatcggccgtaatttcccggtatccccgagccggtttagatacacattcgcaggccctgcaatcaagtgggcatgctttgactgcggaatatagacaagaaaagtaagcagcagcaacagatggatccaccatgccacgtaaaacacaacggccgctgcagttggcccgatccaatgaaaggccgctgcaatcccggctgccaccggttccgtccatgacggctcctcaaagtgccaaatgatttccatgccgcccccgaccaggacagaaaccattagcccgccgataaagatgagcacaagccccgctttaaaatcgcgttttaagcggacgagcttctcaatgtagcggcggtaaaacgcccagccgaccgcaaataaaatgacgagcgtgacgatttcctgaaagaaagtaaatccggggtaaagcggcccgagcggcaagtgtgaacccggcgcaagccccttccatatgaaatcgatcgcgccgaactggacgagaataaacccgtaaaacatcatcacatggatggcgccgctctttttatccttaagcagttttttctgtccgaaaacgtatacccatatttttttgagccgcgccttgacattgttgtcgaattcctgttttttccccaatttgatatactggatccttgtccttaccaaatacacaaaaaggccgattccgtaagcggttacagacaggaacaacagccagttcaaccataataagatgtgcatttttctcccgacgctcccttcattcatttatgctcgcacaaaaaagcaggtaattttccgaatcttgcttacctatattatataatgaatgagcattcagtcaatcttttttctttatttttttgaatttctttgtgcttgtttccgcttttgtaaatagaatcggccgcatttggggaagaataaagacatggactcggccacggaaaaaatcgattgaagcggggaaaaaagatatgattttgctcttattcctttctgccgtcatagtactcatcatctggcttttcaccgattacacgcttggaaaaaggcatttccgcaaaactcgcaaacagcgccaatatcccgtacggcacggagattttactgtttttacatgcggagaaaatctgtttccccactacttttccgatatcctgcatgccaaaaaaagcatatacgtcctgttttatattgtaaaaaatgatgaaatcagccgtgaatttttcagcctgctcgcaaaaaaagcgcgcgaagggaaagaagtaaaagtattgctcgattgggcgggcagccggaaggtcacaaaacagatgattgcccagctgaaaaacgctggcgcctcgtttgccttcagcaaccggccgaagttcccttttttcttttacacgctccagcagcggaaccaccggaaaataaccgtcattgacggggagacaggctatcttggcggtttcaatgtggggaaggattatatcaatggcaacaagtcgctgtctccttggcgggattaccatttccgcttaaccggcggaagtatccgcgacttgcaggaggaatttatcaggaactgggaaacggctacaggagaaaatatgccatttgaaacacatctctctccccatgaggagaaaagcggatgccgccaccggatcatcccgactgcgggcgatgagcttgagcacctggtttgcagcctgattgatgaagcccgtgaatcgatttttatcggttccccgtactttatcccgactccggccatccacaaaaaactggtgcaggctttggcacggggcgtaaaagtcacagtgctcacccccgataaggcggaccatccgcttgtcaaagaggccgcaagccgctatttccggcagctgcttgaaaatggcgcagacatttatttgttcaagcccggattttatcacgcgaaaattatgatcattgaccggaccgtctgcgatatcggaacggctaattttgaccggcgcagtgtccgtttaaactttgaagtcaactgtcttgtatacgacaatgcgtttatccaaaaaatgtgtgcgattgtaaaagaagatatgcgccacgctgtcccgcttacagcagacgacctgaaccgccccggattggcaacaaggctggctgaatggggtgtgagggcaattgaaagatttttgtgataaaagaccggctctgggtcagtcgacgcgatcaaaaaaaattgccccctgaaaactggggcactgccaggcacaataggtggttaacagctaaaccaacgttttggccgtccttgaataacatcttgcagggctgtatcacatgcccttttaaaagctgtcacggaaccccaggcacgtaactgcacgtcatcttgctatttgcattccattttgcttttcttaaacccaataaaccattgcgcaccaaaaaaagccgccccctgaacctgtaaacggatggggacggcttttttctttacattttttccggtgcggaaacgccgatcagctggagcgcgtttttcagcgtaatttgcacggccttcacgagggcaaggcgcgctttggtggcgtccgcatgcgccggctcgatcactttcacagcattgtaaaagctgtggaagttggcggcaagttcgttaatataatttgtaatgcggtgcgggatccgcttttcggccgcatcagcaatcacctgcgggaattctccgagctttttcaggacatccgtttccttttcagaccggatcacggaaaaatcggcgcctgtatccggcacaaaccctttttcttccgcctggcgcaaaatgctgcaaatacgggcatgggcatattgcgcatagtaaaccgggttttcattggactctgaaacggcaagatcaaggtcaaagtccaaatgcgtatccgaacttctcatcgcaaagaaataccgagttgcatcgagcccgacttcgtcaatgagttcacgcatcgtgaccgctttcccagtccgcttgctcattttcattttttcgccgtttttatacaagtgaacaagctggatgatctccacttcaagattgccgctgttatagccgagcgcttccattgccgctttcatccgcgggatatagccgtggtggtcggcgccccaaatattaatcaccgtatcgaagccgcggtcaaatttgtctttatggtaagcaatatccggggtcaagtacgtgtaagtcccatcgtttttgatgagcacgcggtctttgtcgtcgccgaaagccgtcgagcggaaccacgttgccccgtccttttcataaatatggcctttttcgcgcatcagtgtcagcatttcgtcaacttttccgctcttataaagagacgtttccgaataccagacatcaaaacgaacgcggaagtcttcaaggtcttttttcagtttcgccatctcgtaatcgaggccgtactggcggaaaaattcgtagcgcgttttttcatccgcgtccacaaatttccggccgtattcatcggcaagtttttttccaaggtcaataatatcctggccgtaatagccatctgccggcatttccttttccatcccgagcgcctggaagtagcgcgcttcgactgacaaggccagattgtggatctggttgccggcatcgttaatatagtattcacgggtcacctcataccctgctttttcaagaatattgcacagtgaatccccgacagcggcgccgcgcgcatgtccgaggtgaagatcaccggtcgggttcgccgatacgaattcaacctggatttttttgcccctgccggcatctgaacggccgtaatccgcaccatcgtgaaggatagaagggatcagccgggtcaaatacgtattgtccaaataaaaattaataaagccggggcctgcgatttccactttttcaatcgacgttttcgatttgtcgatatgttcgacaatcgcttccgcaatctggcgcggtgctttttttgccgcgcgcgcaagctgcatggcaatgtttgcggcataatcgccgtgtgctttttcttttggcttttccagcacaatagccggaatatccgcttccgcaaccaagccggttttcatcaccgcttctttgatttccgttttcagcgtttcctgcatttgttccgcaatgttcattttgctgcttgtacctcctcataatggatcttcattttatatgtaccgaccgaatccccatgcatataaagcctatatccgagggaaagctgcccggaaagcgagcctgtacgcgtgtgcacaatctcatctgccgccgcttcaatcgggaattggccatagccgttttcgtaagtccccgggcgcctggagccttcacgcaaatcaagccgcatggagaccgcaccgcttctcattacaagcgcccttccgcttgccactttgacaaccgtatgaattttgccggcttcctgcatttcctcgtactttaaataggccgaaccgcctttttcgtaataatggccgaacaaaaccagttcgattttttccgcttcttcctggaaaatctccgtggtcatatgtatttttacagggcaagaaacggtttcccccgccattttcccacatcctttatttcatccattataacctttccggcggaaaaataatatggtaactctcctcattttatcatatataatggagctgctatcccgcaagcttaactttaaaaacccggcacccgcccccgcagccggtgccgggttttccgttacttcacccagccgagcatcatttcgcgcacgagcttgctagccgtattggctgtttgctcggaatgatcatatacaggtgccacttcaacaaggtcacaaccaatgacattcacgccggaacgggcaatcgcatgaatcgatgccagcagttcttttgaggtgatcccgccggcatccaccgtccctgtccccggcgcaaaagcgggatcgagcacatcaatatcgaccgtcacatacacatggcggccggaaagcgccggcaacacttttttgagcggctcaagcacttcaaactttgcgatatgcatgccgtttctttccgcccattcaaattcctcttttaagccggaccggataccgaatgaatacacattcgcgggcccgatcaactccgccgttttccggatcggcgtagcatgcgaaagcggctcgccttcataatccgtgcgcaaatcggtatgggcatcaaaatgaatgacagcgagatccgggtattttttgtaaacggcgcggatcaccggccatgtcaccaaatgctcgccgccaaggccgaacggaaatttcccgtcgtcgagcaatgtcccgacataattttcaatcatatcaaggcttttttgcggattgccgaacggcagcggcatatctccggcatcaaaatagctgatttcagcaagttcccggtcaagatacgggctgtattcttcgagcccgattgaaacttcccggatgcgccccgggccgaaccgtgaacccgggcggtagctgactgtccagtccatcggcatgccgtaaagcaccacccggcttttttcataatccgggcttgccccgataaaaacatggcctgaataagcttcgtcaaatctcatctttttctcctctttttcacaatttcggacacatggaaaaagtatagtgaaattccgaaaaaaagcaagaatctttttacagcgggccacccttcccataatccttttttcggttccggtgtttaaaatttcctctcttactaaatactaaggaaataaggagaaaaagaggtgcggatgatggagacacagacaacaccaaagatccggaaagccaaatggggcctgcgcctgatgctgtttgccctgattactttcgccatcctgctgtctgccttaacggcagctgtctatctgtatgcaaaaattctcggtccgccgccgctgtccgtaccgcaatcaacgctttattatgcacaaaacggcaaacaaatcggcgagtcgaacagcggccagcaaagatactgggtgccgcttgacggcatctccgaaaacgccattgacgcgaccatttcaatcgaagaccgaaacttttaccatcaccacggctttgattaccggcgcatggccggggcggtcgctgccgatatgaaagcaatgggaaaggtgcagggcgcaagcaccattacccagcaatacgcccgcaacctgtttttaacgcttgataaaacatgggaaagaaaattaaaggaagcattctacacggtccggctcgagtccagctacagcaaagaccggattctggaaggctatttaaatacgatcaattacgggcatggaaaatacgggattgaagccgcaagccggtactatttcgggaaaagcgccaaacagctgacacttgccgaagccgccatgcttgccgggattccaaacggacccggagtctactcccctgtcatttcgccggaaaaagcgaaaaaacggcagcttgctgttttgcaatcgatggtgaaaaacggctatattacaaaaaaacaagcagcagcagccgccaatgaaacggtaaaaatcatgcaaaaagcggatccggatacaaaccggatcgccccttatttccaggaccttgtgaaaaaacagctgaaaacaaaactcgggtttgatgaccggacgattgcgctcgggggattaaaagtatataccacccttgatgtgaagcagcaaaaaattgccgaagaaacagtgaaggaaatcattccggcatcttcgcaaatccagctcggttttgcggcaatcaatccgaaaaacggcttcgtaaccgcacttaccgggggccgcgattatgcggaaagttcctttaaccgcgccacacaggcaacgcgccagcccggttccaccatgaagccgctcctttattatgctgcattgaaccacggattcacgccggcaacgatgctcaaaagcgaaccgaccgttttccggccgggcggatcttcatacaggccgcataatttcaacagccagtatgccaatagggacattacgatgatgcaggcgctcgccgtttcagataatatttacgccgtgaaaacccatttgctgctcggacaggatgtgctcgtccaaaccgcaaaacaattcggccttacaaccccgatggaaaaagtgccgtcacttgcgctcggcacatccggagtgcacctgctcgatatggtgaacgcctacagcctgcttgcaaacggcggcactcaaaacgggcctgttttcatcacaaaagtggaagattataaaggccgcgtcctgtatgcatacgacaaacacgagaaagaacgggtgttggacaaagcggcggcgtttgtcacctcgcaaatgatgaccggcatgtttgacaagcgcctgaacggctatgcccgtgtcaccggcgcctccattgtcaaaaacctcacccgcccgtacgccggcaaatccggctccaccaacacggacagctggatgatcgggttttcgccccagcttgtatcaggcgtttgggtcggatacgacaacgggcaggaaatcacgttggccgccgataaaatgtacgccaaaaaaatatgggcccggtttatggaaaaggcgcttgacgggcgccctgtaacggaatttaagccgcccaaaggcgtaaccggtgttgaaatcgatcctgccaccgggaaaatcgcaaccgctaactgcccggtggcaaggctgacatactttatatccggtaccgaaccggccgagccctgcagcaaacatcccgctgcaggagaaaatgagttgtacccgaaaaagcaccggaactggcttgaaaaactgttcccgtttttttaaaacagcaaacagaaaggcctggccgctgtgcggtcaggcctttcctgctccttcaatgcatcgtgaaatttcggccggttccttacgcaaaaataaatgcgcggggtcaggcccttaatgcttctttcaattcatcgctggataagttccacatctcgctgctgtggccttttaaaaagtctgccagcacttttttggaccggtcgtccatatggtctacaatgatatggcccttcatcgacttgtcgaggcggttgacatgttccggcagcgatttgtagccgcggcgtttttccttgttgaccaccatttcgcaggctgtcaccccgtgataataaggcccgttttcgccgcgttcaattgtcacccacacaagccagtacggttttgccccctcttccgggacttccgaacggtcggggaaaaatctcacccgtttttccacggcgctccttgcatgcatcgccccaatatcgacaaccgccgtgccttcattgacatcaatgatcaccggcgagacattttcaaggttcagcgccccggtgccaaaacttttatggccgtcagtcggcgcatttttaataatattaaattctgcttttttctttttttcagccatcttgcacatcccctttctctcaatggcaatctatccgaatacggaaacaatggtctggaatcccttcataatcgacggaaccgcactgttaagcagcggcgagatcgtataccggccaagcggcgtgaccaaaaggaccagaaatacaacgatgctgtactgctcgtactgcgtcaattttgcccgtacccccggcgaaaccaaatcttctatgatccggtacccgtccagcggcggaagcggaattaaattaaaaataaacaatacgagattcagccagacaaaataattgaaaaaggaaaggacaaaccatggcaggcctgcgccaagcccggttgccaccagcacataaaagatgatttccccgataaacgccatcaaaaaattgctggcagggcccgcaaaagataccgccacccctgccaggcgcggatttttgaaatggtagcggtttaccgggacagggcgcgcccagccgaagccggcgacaaaaataagcagcgcgccaagcgggtcaatatgctgcgccgggttcaatgtcagccgcccctcgcgtttggcagtcgggtcgccgcacaaataagctgtataagcatgggaaaactcatggacggtaaaagcaatgatcagcaccgccgcgacaatcgggatatcccttaacggatatgccaaaaactgttgtaattgttccacgtaccggtctcctttaaaaacaatatattgactatagtatacaaaattttcattcggtattcacttgttttaaaagtgccacttgcaggcgggcaaaaaagactttacaatttttaaatgaaaacatccaaaaggagatgcaccatatgccatatgtaactgtcaaaatgctggaaggccgtacagacgaacaaaagaaagcgctggtcgaaaaagtaacggccgcggtcagcgaaaccgtaggcgccccgaaagaaaacattaccgtttttattgaagaaatgtcaaaaaaccattatgctgtcggcggcgtccgcaaaagcgacgaataagggagaaaaaatcgctaagcctgctggacgggcctggcgatttttttcaatttttctatgtaatcgtacgcctcgttgatttcctcctctgtataacgctgcttcgcttttaatgtaaagattttctcttttacttcctctttcggaagcgtgtcaaaatacatgacggttgaaacaagttcaaggaaacgcgcattttgcccgttcatttctgccaagcacgcatccagccccggcagatccggttcgtacatttccagaaattcccggccttcgtctgtcaccgtataccggtattggacatatccgccttttttctcttttacttcgtttacaaacccgagattggtcagttcctctactttgagcgtcaactcttcagaatacgggccgtaaaagtggaactcgaatttttcctgaaacgggaaggataattttttcgcaatataaatcattttttgcagctttttacgcccgacaatctctccgcttatggcaagcgcacccattattttcacatgatcttctaacacaaaccattcactcctgactaaatttccgaactccggggcagtttcagcaaagcggcaatttcccttttcttttccccgtgtgtcgtttcgtcttcgatcaaatcaagcggaaaatacaatttatgatccgttcttcttttccccgaaatggcgtccacaatatccgattcccttgataattccttcaggtcgccgtttcgcatcagcaaattgatcggcagccgttccccttcctcgcccggccggtaaaaatcgtacggaaggtctgaagacgaatcaatgaccaaataatagttcgggtcgatcccggcttcttcaaaaagcttttcaagccggctgtgcaccttaaattcttttgccgggtcaaactcaatgtatttaaacagattccggtttacaaagcgggcgcaaagatcccgcaaaaccgggtcatcttcttcctgccaaacttcaatataatacagcatgatgtgctcatccagctttaaataatctcgcagggtaagcctgccttcaaaaagcgattggaaatggctgggcccgtgtttgaacggataacgggcatcgtacaacgttttcgcgcgctgcaaaatttttgttaaaatcacttccgcacttcttgtcaccgggtggaaatacacttgccagtacatttggtaacggcttaaaatgtaatcttcgaccgcatgcatgccgctatatttaaaaacggcctggtcttcatgcgggcgcatgacgcggagcagccgttcaatgtcaaaatggccgtagcttacccctgtatagtacgcatcgcgcagcaaataatccatccggtccgcatcaagctggcttgaaatcaggctgaccaccagcttgttttctgaagttttcgcaatcacttccgccacttttttcgggaaatttctgccgacccgccgcaatacttcattgacttccgtctccccgaggatgatttgccttgtaaactcctcatggtccataccgaacactttttcaaacgaatgggaaaacgggccgtggccaagatcgtgcaaaagcgcagcgcaaagcgacagcagcctgtcctttccgttccagttcacccggtctttaaaaacatcatctgtaattctcctgacaatttcatagacgccgagcgagtggctgaaacggctgtgttccgccccgtggaaagtcaggtaagtcgtgccgagctgccggatccggcgcaaacgctggaactcttttgttccgatcaagtcccagatcacccggtcacgcacatggacatagcggtggacagggtctttaaacactttttcctcactgagcttacgtttggcgtattccatgctttaccctcttcctgatgtcgtaattctattataccgggacaagcccgagaaaaaaagcttgtaatatgcagataggcagcttttgaaatgtggaggtcgattgacaagtttggtttttccgaaaaaaatcccaataaaagggcgcatctgcgaaaatgcgggatgctgccctttctatctgctgcatcaggttgcaatggctgcattttttaaaacctttgcatttaaagccaccagaatccttgcctaggcaatcttaatgggctttttggcttcccgtgtgtgccccccaactgtgttgctacaagcaaaaatccgtttgtgcgctaaaattctattatttttttaccatattggtataaattgcgtgttttttgtccattctcttagtacaaacaaaaaatttacatttgggggtaatgagaatgaaaacacgtcaagatgcgtggagcgaagaagatgatttgttgctggctgaaacagtgctccgccacgtgcgcgaaggaagcacacagctgaatgcttttgaggaagtcggcgataagctgaaccgtacatccgccgcctgcggtttccgctggaatgcggttgtccgccataattacgaacaggcgctgcagcttgcaaaaaaacagcgcaaacaacgccagcgcctgcttggaaaagaccagggcgggaaaaagaaactgctgtaccagccaccggttccaacactcgaggaaattggcgaaatgccgcttgctgaatttccagaacaaccggctccggacggggaagaagctgaaaacggcagcccgcaagtttcacagccgaccgaaagcaacggggatatgagccttgtcaaggtcatcagctatctgcaatacttgaacaatacgcaattccaaagcacgattttaaaaagtgagaatgcaagattgaagcacgaaaaccaggaattgaaaaaggaaacggaagaattgaaaaaacgtgtccaagagctcgaagaaagttcggttaccatgcaggaagactacgaaaccttgatgaaaatcatgaaccgcgcgagaaaatacgtccttttcgaagaagacgaaaccggcgcgactaagttcaaaatggaccgcaacggcaacctcgaaaagctggcagaataagttccgggcgagcaaacaacaaaacccattgggcggtgcatgctcaatgggtttttaatgcccggggcaggcaatcatccgggcatcggctttttgaccccggtgtgttttgtcttttggagccattctaaaaaacaattggacgttgttacccgggggtctttttcagtgccctcccagccgcgtatcaaaatgtctttcatccgcttcatgaaggataaaacagaggccatcaccggccccaaatgtccttcatccgccccatgaaggacaaaacaatctcaccacaacctccaaatgtccttcactcgcccgatgaaagacaaaaacgggctaccgccactttaaattgtccttcatcccgcacatgaaagacaatggactccggccacacctcaagaatgtctttcatcagatcaaggaatggcccattatcatccattctttacaaaaaccgggcgtttctttccagcatgcgttcataatatttgccgtaccattttgtttcctgttccgaaagcgggcgggacacaagccggctccccagcgtcttcagcgtttgcaaaagccgcatgaaaacgtcctggaccgtgagtatttcctgtaaaagctccgacaaagaagccatcacttcaggacggacacacgggtattgcaactttgtctccgcgccctgttttgcccgctcataaaaatcctgaacgagttctgccctgtcggcgccgctgcccgtcacgcataaataaatctggacagccacccctctcctgacccgccgctgggagatgccggcgaattttttcccgccaatgctcaaatcataactccccgggcagtacgagcctgctatttcccccgcttcaattacaaccggaaaatccgaaaacatcatttggaccagcttaaacatcgcttcgtatccgcggttgatatccatccccttttccgtatccggcataacaagcgaaatgttcagcacgcccgtatccaatacaacggcaagcccgcctgaattacggacaatataccgaaatcctctatttttaagaacagccagcccctcctcaaaaaagggcaattttgtatcctgaatgcccaggctgacggtgtcgtgatgcacccatgtccggacaacagccggggaggcgtttgcccctacagaggtgcacaatgtgtcgtccatcgcaaatgactgggccgcttcaaactgcgggcccaacccggactggtccatcacccgccactcgggctgcttcagcaattgcagcgcttcttccatgttgatccttcccccatttattttactactatcatatcatgccggattgactaccaaaaagctgctctcgaaacccctctattggcaaggattcgagagcagtgctgaaccatcggctatcgcatgccttagtaaaaattgccccggctgcacataaattcccaatacgatcaaattcagccttttcccttttctccccaaattcttccattataaaatgccttccctccggccgtataaaacataaaaaaggtttggcatcatgcaaaagccaaaccaaaagaaggcaagcactctaatccccggcgcttccggggggtgcaagccggaaaagaggagtcccggccacataccaaaggccattttcccccgcaatgtccaacagctttactactgtgccggctgtttgccacttttccgctcatgccgaatcattgcggcatggatacacagttttatttcattttgttaaaaaaatcacaatgctgccggacgcggacattgccggcaatttgcctgccgggctgctcccaaggatcaacccgttctcctccaaactttgtccacccaacagccggaagcctggcaactcccttacaaactttgtgccgcggaaatcaaagccaaatgataaacatcttccgcattgcagccgcgcgacaaatcattgacaggcgcattcagcccttgcaaaatcgggccaactgcctcaaaaccgccaagacgctgggccattttataaccgatattccccgcatccagatttggaaaaataaacacggttgcattgccctgaatcacggaatccggcgctttcttttgtgcaacagccggcacatacgcagcatcaaactgcatctcgccgtccaccacaagctccggatcgcgttcttttgccaaccggacagcctgcgccactttctccgtctcatcggaatgggcggagccttttgttgaaaagctcagcatcgcaatccttggttcaatatcaaatgtccgggcagtttttgcgctctccgcggctgtttccgccaaatcctggctgtccggtgaaatattgattgcacaatctgcgaaaacaaatttctcttcgcccctcaccataatgaagacgccggaaacttttttcacgccctgctttgttttaatgatctgcaatgccggccggactgtatcagccgtcgaatggatggcaccgcttaccagaccgtccgcctttttcaaatagacaagcatggtgccgaaataattgacgtcttttaatatttggcgcgcatcttcctccgtcgccttgccttttctccgttccacaaaagcctgcaccatttcttcaaaaccggcatagtcttccgggtcatacactgcaacgccctcgacggaaacaccgatgtcccgtgcttttgcctggatttcgtccttgttcccgattaaaaccggccggatcacttcatcggatgcaaaccgtgagacagctgttaaaactctttcatccgaactttccgggaaaacaatcgttttgttgtgcccccgcactttttcttttatcccgtcaaaaaatgtactcacgctcaacactcctcgtataacggtatccattttaaggataatccatttttccggaaaatcaaaggcaaaagaaggcttcttttagacaatttcgcggtagccgtaatattttttcccttttctaacctgtgttatagtaagggaagagaaaaacatttggagggaaaaaaatgagcgaagcagcagaaacactggacggctggtactcactgcatgatttccgttctctcgactgggcgggctggaaggcgctgcctgccgaggaaagggatgctacggtgaaagaattccggcaatttcttcagcaactggatgccatccaaagcaaacacgaaggggcttatgctttatataccatcaccggccagaaagccgactttgttttatggacgatgcggccggccctggaagacctcgaagaaattgaaacagcctttaataaattaaggattgctgattttaccattccggcatattcgtacatcggtgtaaatgaactgagcaactatgtgcgcggcgggaaagcggacgagtctgcgtatgaaaatccgcgtgtccgcgagcgcctctacccgacattgccgaaatccaaatacttctgtttctacccgatggataaacggcgcgaaggcaatgacaactggtacatgctgccaatggaggaacgcaaggagttaatgaaaagccacggattgatcggccgcaaatatgccggcaaggtaaaacaatatattctcggttccaccgggcttgacgactacgaatggggtgtggctttattatccgatgatgccctgcagtttaaaaaaatcgtctatgaaatgcggtttgacgaagccagcgcaaggtacggagaattcggcccgttctatgtcggcagcctgcttgacgaagaacggttaacctcctatttgcatattggttaagaaaaatccttccagcctgctggaaggattttttcacgagagatcttaagcataacccgtttccggccggcatacacataaatgtagtgaatgcccttgttttttgtgcattttacaaaaaccagggcagaccgatatgcaaaatggagggggaaatcagttggaaaacggcaattacacaccgcccgtatacggatatccttattattaccggcagtccgcacagccttattacggaggatattatccgccgtaccaggttcccggggggcagcaagcgcaggcaccctcacagaacctgcccggccagcttccgcttgaacaatcgtatattgaaaatattttgcggctgaataaaggaaaactggtcacgctgtacgccacgtttgaaaacaaccgggaatggaatgctaaagtgttcaatggcattattgaagctgccggacgggaccatgtcatccttagtgatccgcaaaccgggcagcgttatttaatcccgatggtctatgttgattacgttgtcttctctgaagaaatcgaatatgaatacccatatggtagcacaacgcaagccggtcagccgctggcaacctatccgccgcggtgatcagcgaaagaaaaaacagctccgaaaccgggctgttttttcttacatccactttaccgccgctatagcaagcagtatccaggaagcaaggaacgcgacgcctccgattggcgtaatcgcaccaagcacactgattttcgttaagcttaaaacataaaggctgccggagaaaaggacgatgccaatcagcatcaaccatcctgaccagctgagcagtgcggatgatttgaggatgccggaaagaatgccgatcgcaatcaacccgagcgcatggtacatttcataacggacgccggtctcccaaatatccagatacttctgatccatgatccctttcaacccgtgggccccaaaagccccgagcgcaacagatatacatgcgttaattgctccgagaaaaacaaaaatattcatgcgatgcactcccgttttttaatatgaaacgctgccaacgtaaatgttcaccatacaaagctggataccaataggaagctatgatggcagtgcaaaccgtataagaagctgcagaggaaaacagggactcccgcttggctggcgttgtttcaattgtttgcgattaaaagtcaaaaatagagtccccgtttgcaccatcttccgttttcaacggctccggattaagcaccggtttcggcacagaaggaccggcaggcaatggctgttcaggctggctttccaataaaacttcgcacaaagcttttaccgcatagatatgctccctgagttgttccgccggcattgcctgttttgcctttgccaattcctgctccattttttccaaaagcatttccgttgtaatggccatatccgcacctctgttcaatttccagcctgaaaatttgtgccctgttgttttccatcccactgctggtgccgcgttacgtgcagcatgggtgaagattggtgatggctgagtttcattcttccgatcgcatcatggcggcatggtgccggccctgacaatgtttccttcctttgatagccgcctttgccgtctgctaaaatgacagctgccaaaagagattccgtttcttacatttattttaacagaggccgtctgtccgaacaatgcggaacgctgtcatactttgcaaaaaagccgccatgtttcacgtggaacattgtcggatttcctcgatggaatgcgttttaaagcttttcctgttccggcagctgccagtcgatctctttttctcccaacttgcgcaaaatattgttggtttttgaaaacgggcggctcccgaaaaaaccgcgatgggcggacaacgggcttgggtgggcagcagttaaaacgaaatgtttgttggtgtcgatcagcgcttttttgctctgtgcaggcctcccccataacagaaaaatgacaggtgtttctttcgcattgattttccggatcacttcgtctgtaaaaatctcccatcccattccctgatgcgaatgggcctgcccctccctgacagtcaacacggtgtttaacagcatcacgccctgctttgcccagctgaccaggcacccgtgctgcggaatcctgcacccaaggtcgtcatgcagctctttgaaaatattccggagcgaagggggaatctccacccccggctttactgaaaaactgagcccgtgcgcctggcccggtccgtggtaagggtcctggccaagcaggacaaccttaatatcccggtaagccgtataatggaaagcattaaagatatcgtacatatcagggtgaatccgctttgttgcatattcctttttgaggaactccctcaattttaaataatatgctttttggaattcctcctttaaaagcgggccccagtcatttttaaagatgtctttcattccgtttacagcccctttctatcatctaatttaattttaccagtttccctgtccggcggctgtaaaacttttctttgtttaaggacggcaggaagcggttatataaatgtcaaaagaagcatcaccatttttcggaaggaggaagacagatgcataaaatagaagttgtcgaaaacgggctcgaagcgacaaataagacaaccgagtttgaaaatgaaggattttcgaaagacaatatttatattttctcgcatgacaaaaaccggtcaaaagatttaaccgatgcaacggaaaccggatcggtcggcatggaagaacaaggggtcgttgattcggtcggcaatctgttaagggagcggggagatgagctgcgttcgaaaatgcaggcgctcggattgtcggagatggaagccgtacagtatgaaaaagtactcgacgaggggcgcgttgtcgtcatcgccacggataaccaggaggggcctgaacacctgctataaaaccggaccgggccggcgttccttaagccggcttttttctgcttttattaggttaaatggctcatattcagccatcctgggacgtgtctttaaaccaggccaattaaactaacagttgcaaaaattataaaaacagatcacttaagagagacaaaaaactgtcagctgataattctagtctgctcaatatgtaaaaaaaggtaaacagactgggtagtacttgacctttttcaatccgatgaaccgttttttcggataatatgttgcctgcaagatccttttgcgtcaaacccttttctaatctggcagtttttactgctacccctacattttcggcatttatgattttttgtaaaaacatttcctctgattgaaattgtttgtcttgatataccatcagctcccaccccatatgatttgagtattctatttttgatttacaagttttgatttacaagcttatcatttcaaattaaaaaaacgaacaattaaaaattcaaatcaatcacaaaatctttcgatactttttattttaataaattactgactgttgtcaacgaaaaatttttcggcatcactaaagatatatgctgaaatctatcagacactttttccaaaagctttacttcatcacccatccttctgttttcaggtataactggacacatgtgtctattgtcaacaaacacacattttaataacatacacttgaacaaattgataatttccaagcaataaatgatataaatgtgcataacatttatataaaagttattaaaataggcccttcgggttaaattaaaatctaaaacttgaaacactaaaattcattctcattacttgtcttacaagggtttagagcaaaaataaaagcatgaacactggaaactcggtataattgaagtgctaactaacaattaatcgaggagtgttcatgttatgaaaattataacacaaaacgaccatcaatctcttgaaattttatcttcaatcgaagcattttttttgcgtttccgcttatctcaaattgcgaaggtttcaaacgctgtaaagacaaaaggtgttccatttcaaacactgttctgttatttgatcagtacacttttctcaaacagatctgcataccgtgattatttgaagcatcaagatcagctcggattctcagataagactttccgtaatctactgaataacggcaaaatcaattggcaaaagttcttggttttgctctgccgccgtatcattgtgttcatcgaacccttgaccgaaccaacacgccggaatgtattcattgtggatgattccatgtatgagcgagccagcgcaaagcacgttgaacttgcggcgtttcagtttgaccatgcgaaacacaaatatacccgtggctttcggtttcttcaactcggttggagtgacggcaatacattcctccctgttaacttttccttgctttctggcaagaatcaagtgtgcagcccaaaatccatcgacggccgtacactttcaggaaagcgtaagattcaggcacagcgcaaagcaaccaatgtagtgttggaattgttatcatcagccttgtctcaaggagtgaatgcttcctacgtcttgtttgattcctggttttctagccctaagatgtttcatcagttgcgtgaactgggacttcatggagtagccatggtgaaacgttctaagaaagtttattaccagttcaacggtggactgattgatgtgaaaacgatctttaacacccagaagaaacgtcgcggacgttcacgctatctgttatccgttcttgttgaagcagttgacggggaaacgtcggttccagtcaaacttgtttatatccgcaaccgcaataaacgaaatgattaccttgtcttggcgacaacggacacccggctctctgaagatgaagttattcagctttacggaaagcgctggtcgattgaagtatacttcaagatgtgtaaacagtacctccgcctggcaaaatatcaaggattgtcttatgacggtatctttgcacataccgctcttgtcgcaattggttactcaatccttgcagtccaacaccgtgaacaggtagatgatcggaccctgggtgagttgttttatctcatggttgatgaacttactgacatcaccttcgcagaagcgattcaacaattgattgatttatttaaagaagcttttaaggatgagtatatcctttgtgaagaagtactaaatactattattgagcaatttttaaaaaaattacctgtcagctatcaaaaacacctaattaaagcagcttagctctaaattagccggggtaaccgcagtggtgacaaggggtttgcacgattttcgtactttcaagttttagttaaaataataaaaatattaaattttaaaaatgtaactaatcccgagggtctacttttaaaagggaggtgaatataatatgggattattccacgttgcatctaagtttcatgtttctgcaggaatagcatctggtgttgttacagctgtattgcatgctggtactatagcatctataataggagccgtcacagtagttatgtcaggtggcgttgatgcaatcctcgatatgggatggacagcgtttattgcagaagtaaaacatttagctaaggaatatggcaaaaaaagagctattgcttggtaaaaactggaacagccaggatctacagtcctggctgttaaaaaacatttattgatttttattgtggagtgatgtttatggggatttttaggcttgttatgctatatatcataaatacatactcaacccgaggttttttaataaaaaaggtactgaaaataaagagcactaaaaaatacattctattgagttttttgtttgaagtctttatatctgtatttttaatttctatttttaacaggatctttttaccggaccataaaaatattcttattggagtggctctgattctgactgttggcgaccaagtgaaagctgttatgacaacaagaaaaatgttagatgaaaggtacttggtctatcattttagcaggtatctcgggaagaataacaatttaatgaaaaaggttatactgctcgactggatggttagcatggtgcaaagtttaaccaaaatcgtgccgtttggggtgtttttttatttacacaggatgggaacgaagtacatattgattgtgattttgttcgaactgctcctgttttgtattcatttacttggaaaatcgttatcttatcataaaggtttccgtattgtactaaacctgacaacaaaagctttgttatgctgcttcgtttataccgttgcttccatcttcatgcaaatcatttatgaatcaagacgtaacatatctacttatggatataaattaaaagccatcacaaatttaaataatcaagcaaaagaaatacttctaagctcaaatttgtttatcatttttaaaaatgcagccttgtttgttagccatatgcatattctcacggctactttaaccgtggtattgctattcatcattagtattatcatttttgctttctcaaaagatacgaaggaagtttattatcaaacgcccttctttggttttttatataaaacattgaataaggagcactattatacctatgctgactactattctttaaaagcaaactcaaaagaattactgaacaatccttttgacctgtttatcacgggagaactttctgtcagtacaggaatttcattggcctcggcaccttatattcataatatcatcgttacccttatttttatgttttttcagctccacatcattctgaagggagcgataaacactacaagctttatctacaaaaaaatttttaagcttgaacaagaatgttctatgatggaaatttttaaaatatatgagttaaaaaagaatggtattctattctcaaaatatgaattattaaaaagaacgatcaatatatatttattttgtcatttgtttttgttctttattgcaactttgtttatttcgtttcaacaaagtctatcttttttgattttaattccatttttttatgcaataaaaaacgaatatgttttatactcacttagaaccaattatgacgtttttgttttattacttagcaaaagtaatcctcccaaaattaacaggctgaatgaattcgatggattctctttaattgctacagcgaataatgtattatctaagcttgtaacccaatttacaatattagggttgatcataatagcgatgttcaaatttatctcggggatttattggctctgccccttcttggctatcgcctttactctttttggacaagtagtttacagcaacaaggattacaaaaaaatcaaacagtcctgtcaataggtttattaaaacaaaaaataactaaacacggggatttaagaatttatgaaaaatataattaccacatataaaaaatacttttttgtttctttagccgtttattgtattagttttataaccggagcattcttatcaaaatttttaagtttcaagtataccgaaaatgagcaaagatttgttgacctgtttcttcataattatacattggggcttaaaatcatggtattaggttggattagtttgggtgtaattagtataatatatttggggtataatggggtttttttaggtgctttctcatttgcaattataagaaaccatgggctcaaacctgtattaaccggaataatcccacatgggattatagaagtaattgcatttttgctttttgcaacaattggctttgaaagcctgcgttgcattaacattttaaaattgaattctaaaagtgaacaagagttaagatataaagttgaaattataaagttagtatcgatttttcttttcgcaaccattttattggtaattgctgcatggattgaagcggacatatcacatgtatgaacggaagtgaaatagatatggaaaggatatcaataaagcatttaacttatggttatgaaaatcaacccaggttatttaataacgtaaatatcgagatagatcaaaacagtattgtaagattatatggaaaaaacggttcaggaaagactactttgctgaaaatcattgcaaatattatagacgatcctcatctgtcttatgagttgcggttttttggtgaaaagctaagttttgcagacattcgcaagcgtagagtatttgttggagactctcctgtattttatgaagaattaacaatggaacaaaatattcaattttacaatttgttatttcattacggccctgtattcagcaaacaagtatatgaatactgtaaaaagtttgatgttgatgcctataagaatgagcaagtgaaaaatttgtcattagggacccggcaaaaaatctttttatccattaacttatcgatcccttcagaattggtcttattggatgagccgtttaattccttggacacttccagtagaaaagttttatctgacatcatcacacaaagtaagcaaaaaacgtttgttattgtgtcacatgaaaaggaagcaagcctgtctttcacacatgaattaaatagcgaaaattggcagttaaaaagtttaaataacacggatgggggtgtgagagaatgaaatccgccatgttcacgctggtactaatcgccatttttgtttttgtctatattaaaaaaacggggatttcaaatatatctattccaaagttattgtttataccggcgatttttatcgcagcctattttatagacaaaaagttgcaacagaaattacgaaaataagcattcataccagcaatttcctgggccagttgccagattaaacataggtaaaacaacgatgggaatgcacttttagaagaagctggtccggaattgcgcaaattcatcgttgtggaacgcgacgtgaagcaggagcagtttcctcccataaactaaaaacgccgcacaagattgtttcttttcacaaagggcattgaaaaaaaacacccattttgtaaaagaaggatacgtatgccctttttgaagaaaaatgccctttttatttttattgaatttgaaaacctggaaggaaagccaaaaatacgggatcattcattttccagcgcctcgattaagggtaatttttaattcaaataataacatttatggaatcctcatttttatcattttttcagttataaaagatgttcatcttgaagtgtacaattagatgatagagcgtcttcccatttttttccactcatctgccccgtcgagtaaaattttacacatacaaaaaccgtctgttattcccgtaatgtattttattcatctggatgcagcaggcaaaaatcagggagtgcaagcacggctttcactcccctcctgtatcattttttaattgtaaactccccaatctccctctccagttcctccgtgagggtgaacagtttttctgtgtagcgggagagttcgccggctgaggcggcttgttcttccatggaagatgaaatttcttctgaagcggcggcagtttgctgggaaacggcggacaggtcttcaatcatttggacaacggcatctttttgctccccgatcgagcggatcgattcagcttcctgtttaattgagctgagcatcttctccaatccttcggccaaaacggcaatcgaagtgctcacggagttgaccgcttttttctgcccggtgctgatttcatttgtttcccccacgacgtccaccagttctttcatgtcttggagcacgtccgcaatcgttgcccggatatcttttgccgactgtttcgactgctcggccagactgcgcacttcattggccactacggcaaatcctttcccgttttcaccggcgcgcgccgcttcaatcgaggcatttaatgacaatagattcgtctgttctgcgatttgcgtgatcacatccgcgacttgtgcgattgatttcgatttttcattcagcccggccatcatcgatgtgactctttcaaaagcctgttccagtttttgataagaggcttcgagattatcgacctgtttcgtaccggatttgatctctgtttctgcttgatccaccgcgctttcaatgacctgcgattgtgcggcgagtttttcgatttcgccgcccaaatcgcgcattgcatttgatccggtttcaatatgatcggactggttggctgcgcctgccgcgatatcttccaccgccttagaaacatccgtcacagccgcttcattttcttttgtcaccgtacgaaggccggcagtggacttgttcacggcgtcgacactgtccctcacttttgcaatcaggctgcgcatattgtgaagcatggcgttgtaacttttggccagttccccgatctcatcattggagcggaacgcaaacgctgtaaccagatccccttccgccgttttggccaggacttgctgcaagtttttgataatcttcacgagccggccggcaatcaacacagcaaagacaatgccgattaaaagcccgatcccgattgaaagaaggcccatcttctttattttgccaatctgggcgctgaactcggactgcgggttaaacgaggctactttccagccggttttcgggatcgttgtggcatagacatcataccctgccccgttccagtgaaaagttgcggccgccgtcttttggctataaattttttcggcaaaagcgaaatctttttcgagtcgggtgctgctttcaatatcttttaccccttctacttttccgctgtttgccggcctggcatttttcccgtcgccgttttttaaaaacgacgtcacgatcacgcccttcgcatcaaaaatcgcaagtttgttgtttgaatcgtgttcgatgtctgcccggatcttgcccatttcggataaattgatgtcatatccgacggcgccggccatcctcccgccggaaaaaaccggcgcgacaacagacgtcataatggcgcctgtcaccttgtctttataaatatccatccactgaagttgcggctttttctgcaaatagcggtatgtattcgtattgcgcacatccagattaagttttgcatacggggaaatatggagtttcccggtctggaaatccatataataagcggaagcgagttgcttattccgtgtctggaccgatttgatttcagcttcaatgtcctgcatcttgtttttccgctggagatccgtttcgacaaggccggccagctcgtcaagtgacgtttcgtattttgcaagccctgcttcgacctgcgatgccgcttcatttgcgaccatttggttgacgccgcggtttttcgtttttaacagatggcttgtggtggcatattccagtccgaccgtcgccaaaatggatatcaaaatggcggcgcaaatcaggccgccccatttgacggtgagcggaatgaatttcttttgctttttcaatgctgtctccccttcgttgtacattctcacttattaggtatcggaaccatcccgcaaaagctttaggcaaaggcttgaattcgttgtttttgaaagtttttgatattgggggctggcccggctttaggaccaaagccgaaacggaaggcatctatagcgacggaacagaattcattttgcagtaaaaaacggcggagcatgcccctgccgtttttttgcctgctattcgccgtactgcgctgcgagccggttcaatgccttgtgcaatttttcatataccacttccttctccgtccggaaatcttccccttcccggaaaaaaaccggcgtgcctgtaacaagcaatcgtttcgtcttgctggcgtacaaagggacaaactggacgtggcggccggttgctttgtaaaaatatttttccaaatacaggaaaccctcgtacatcccttttacacccgccgcgttgtctgtgtagtcaatatcgggataaatggcgatgctctccccgttctttaatgcttcgacgctttcctgaaacgtccggatgattttgcgcgagctccggaaaacgggaatgcctctcccggatttcagcagcttcgtgattccgaatgacagaaaaaaggcggccgggttcgccaaagcccgcggcaagccgaatctttttgtgaacgtgtaatcggcgtattgcctgctgcaagattttcggtcaagaaaaacgtgcaaaatccaggtgcggataaattccggataccaaagcaatgtaacaaacgggccgaataaattgcgatgatgtgaaacataaacagccggtccggcaatttccccggaaatttgcgctttgtaggacggataaacgaaacgtacaagttggcgcactgatttaaaaaatagtccgtaacctttagccatggcgcctctcccctgccagttgcccatattccggatagccggaaaaaatcccccaatgaagctggagctggtagaagaaaagggcaagaaaaaggcttgcaatcgtttttgccagcacgggatcaaattgaagcagaccggattcggcttcgatgaataagaaagagaccacgatgaacaacaggcatgccatcaagtaccggactaaaaatcgtttccattttaaaagcctgtatttgaccataagaaagacggcaaaggcaaccacctgtgaggcagcagtggccgcgagcactttccatacatgcggaatccctgccaggacataccggtataaaagcgagaaactgagtatatctgcgattaaaaagatcagtgcgggaaaagcataataaaaaagcccggatatgattttacggaagattttcaacgaatctttaaccggccggtaatgggtaccttcgttgcggttaaaataaatggtgcggatcggcacttcccggatttttacgttcatttttcttgcataaatgagcatgttcatttcatactcaaaccgttcgcctttcagcgccagcagccagccgagctcctgcttcgggatgccgcgcaagcctgtctgcgtatcgccgatctctgcgccgtacagggctttaaagagaaagcttgtcaaacgattgccgaaccggcttttgggcgggacatgctccaggctaaaatcccgtgcgccgagaatgatgctgtgcggatgttgccggaggcttgctgccattttttcaacatcttccggactgtgctggccgtcacaatctgctgtgaccacaccggaaaggctgccgtgatgcgccaaaatatgagcaaaagctgttttcagcgcacgccccttcccgcggttcgccggatgatggagcacggtgcatctctctttttgcgacagcatctgaaaaatcggcgcacatgccgggctgcttccatcgtccacgacaataatccgcgccgctccttttgccaacaggcgatcggcataatggacgagctgcgcttccggattcagtgccggaatgacaactgcgacatttccgatcatatcatccaacccccttttaaaccaatctgtctagaaaaatatcctattttcatattacatggaaaagaggagaaaaacaaagaaccggcattgttccggtgcagggaaacggccgtttttccgaacgccaatgccttactcttaaacggcagcgcgtgcccgtttgccccgagaaaatgctcaatcgaatggtccccggcttcctttttactccattcgcaaatgcttttccgacaaagtccaggtgctctttttcagtaacttcccggcgagtgttttcccccgcctgtttgttacaaacggttgaagaacgggtaaactactgtcgtattccatcggagaggagtaaatgaagatgagattgaaagataaagtagcgattgtaaccggcggcgggtccggcatcggggaagcgtccgccttgaaacttgctgcagaaggcgcaaaagtttgcgtaatggatattgaacagaaacgggcggatgaggtcaaaagacggattgaacaaaatggcggggaagcgatggctttggaagtcgatgtcactgatccggaacaggtgaaaacggctgttgacaagacagtcagggaatgggaccggcttgatatcgtattctcgaatgccggcattaacgggaccgtggcaccgattgaagacttgaccccggatgactgggaaaaaacgttgtcgaccaatttaaaagggacttttctcctcacaaaatatgccatcccgcatatgaaaaataggggcggcagtatcatcatcacgagctcgatcaacggcaaccgcattttttcgaacatcggcatgtccgcttacagcagttcaaaagccgggcaggtagcgtttatgaaaatggcggctttggaacttgcccgctataaaatccgggtcaatgccgtttgccccggagcgattgaaacaaaaatcgagcaaaacacgaaccgtacggaagaactggaaaaggtgcaaattccggttgaatttccggaaggcgaccagccgctttccggaaggccgggaaaaccggaagaagttgccgatcttgttttgttccttgcatcggacgattccagccatatcagcggcacagacatctatatcgacgggacggaatcgctgctgcggggataaatggatttttcacaccagctggcgggcctacggggtcctagcgtttgccgggtgaatccggttcgctcggctattccataacggttgctttgaaaaagtgaaaggctggataaaatcatttaaaagacggtaacgttctccatgtccgccgcctttttttgcgttttttaaaacgggtacaagaggaacacagtgcttgtaatcgtactccgcaaactacgatatagggcttactgaatacataaaatttctatatttgataaggatgttgacagcttcggcagaaattggaaatagcttgcacctgaaagctgattcaacgtatagagaagacagaatcgccttttcgaagacggattcttctattttttgagacataacttgcttgctgacaaattgggtacaaacttagaatcggattcgttcagcaagccctaacagagacgacctatatgttagggaagagcctcgtttttacttgcttccttaacatagacgggctctatgtgaagaaaggccgtcgtttttcttcattttcttaacgtagacgacctctatgttaaggaagaccttcatttttccacgctttcttaacgtagacgcgccctatgtaaagaaagaccttcgtttttccgcgcttccttaacctagacaggctctatgtgaagaaaggccgtcgtttttcttcactttcttaacgtagacgacctctatgttaaggaagaccctcaattttccgcgcttgctttacacagggcttactgaacagagcggccacattttgttcattttatatagtcggttttttaaaacgggtacaaaaggaatgtcaacacggcggtgaggatgcctgttatgatcccgaaaaatacttccgccggtttatgccctaaaagttctttcagtttctgccgggattcggcatttttcagccccgggtctttcattgtatcgagaagccgggagaaatctgcaagcagctggttcagcacttctgcatgaaaaccagcctgcctgcgcacaccgatggcatcgtaaataacaatggatgaaaatacgatgctgatggcaaatgcattggaaccaaatccggaagtcagcccgatggcagtcgtaagggcgataaccatcgcggtgtgcgaactgggcatgccgcctgttgaaaacgccattctccagtcaaatttcccggatgtgatcaattgaatgggcacttttacgatttgtgccacgagcatgccaagtaaagcggataaaatcggatatgataaaaacatttttcctccttactttcactttcatgaattttccgtgcatgacgaaacaccattatttccacccaaggccaggccggctgattgaaaaaagcggcagcgggtgtgggatattgtcttttaacaccatttggctaagcatctctccaacactgcttgcaaatttaaagccatgtcctgaaaatcctgcggcaatggccacattgggatatgcaggatgggtatcgataataaaatgttcatccggcgtatgggtatacaagcatacttttcccttttttaagcgcccggctgcccttggcatgtatgttttcaaaaatgcccggatatccccctcgtcttcaccgtatgcaccaaattcccggttcattgtatcaggatctgttgcctgcccaccgtcatggcgcccgactttcacgccgcttccgttaaaacttggaaagccgtaatatgttccttcgtatccgtccattgtaaaagccggaaacacatccgcattgaacagtgcttcgtccgcttcaaaccaaccgaccgttttccggaccggctgaagcggcaaatggagccctacgttttcaagcaatttcccgttccacgcaccgccgctgacaatgcatttttcagcggtgaatgtgccggtttctgttacaacggtgacagtttgtccgtcggttttcaaatctgtaacccgggtattggcaagcaagcgcgcaccttttgcttcctccagtttacggtaggcgcggatacaattttcgggaaacaggacgccggcatccggttcataaatggcctggaagccagcgggaagtgaaatgccaggccagcgtttttccacttccgcgccggtcatcattttaatcgggaggttgtatgtatttgcgctttcgattgcttcgtttaaaaaggccgcatgatcctccgggctgaaactgaggacgccggtcttggcaaaaatcttttctccggatgccttttccagttcatcccaaagcgtttgcgcccgcaacacgagcggcacgtaatcccgtccttccccgtaggcatggcggatgattctcgtttcgccgtggtggctgccggatgtatgcggcgggtcaaaagcatccagcaaaagcgtttttacaccttgccttgccagaaaataaccggctgccattcccattgaaccggcaccaacgacaataacatcgtaatgtttctccattgtattccctccctcgttattataactataccatgtagtttggaaaatgaggcaaaaacagaagatgcccttttaataaatggcatcttctgtaacaaggtcgttttctgcaaaccgttcgacccggagcggtgtaagatcaatggtttcatactttccggtccggatcagttccgacagcccctttccgacagccggtgcctgctgcatgccgtgcccgctgaacccgaatgcgacaaaataccctttcatttccggatgctcgccgatgatggcattatggtcggccgtattgtagtcataaaggccggcccagccgcgttcgacttttaccttttcaaaattcgggatgcggccagcgagaataggccaaatctgctcctcaaattcggaccgcttccagctgaagtcgatcgccggcttttcctcttccccgtatccggcaatgattttgcgcccctcgtgcctaaaatagacaccggtcggatccatcgtcagcggcaacggttttgcgagcggtttttccacatcaaacataaaaatccgccgcggtaccggtataaccggaagtagcaatccggctttgctgctcagtccggaagcccaggcgcccgcacagttcacgacaacaggtgcaaaaaacgcccggccatccttgagctgcacgccttttatccggccctcttccgctaaaaagcggtccacttcttcatacatatactccgcgccgagatgtttcgcattttttataaacccttgcatcgccgtgtacgggtccaaatacccgctttccgcgcaatacagcccgcctgcaagatcacgcgtgctgagttcgggaatgagccctagcagttctttttttccgagccattcagatgagacgccgttttggtgctggagtttcaaatgctttttaaaatgcggcatcatacttggtgttgccaaaaacaagtagccccgctgtttcaaatcaacttcaaacgtttcgctgccgattgtcattgatttggaaaagtttcggtaaacttgcaggctgtaccggctcatttgaatattgaccgccgttgtaaaaagctgccggatgccacctgcgctccgcgaggttgaggcatatgcatacgaaggatccttttcaaacacaatgattctgccggcaaatccatccgcgagcaaatggtacgccacactcgaaccgataatcccgccgccaacaatgatcacatccgctttgtttttcatcccatcccgcctctattctaaaaatagtcgcctcattcttccgctggcgccgtatgcacgggcctctatcctgaaaatatgtgccggctaactttcattcttttgctagagccgcgttcagtgcggcatgggcgtctaccctgaaaatatgcatcgctgatttttattctcccgttggcccataagcatgggcctctatcctaaaaatatgtgccggctgattttcattcttttgctagtgccgcgttcagtgcggcatgggcgtctaattgttgtcgacctctcttttttgtctttgccaatccactgatggcgctgcatgcatgggcgctaattgttgtcgattttgatatcgcgtacgcctgattccactttcaacttgtggtttggaaaatcttaaacattcatgctgatcattttgcccctgttcctattggcgcgaagataaagcatggcactttttacctgccaaacatgtaatgatgtgctgatccgttttcaccctgctgcccgtgcggcagaggagcctaattgttgtcgatctgggcgcgctgcagtttcccgctgaaatcgacatacacggccttccattccgtgtatacatcaagtgctgccggccctgagtcacggtgcccgttgcccgttccttttgtcccgccgaacggcagatggatttcagcccctgtcgtcccggcattgatgtagacaatcccggtatccagatcacgcatcgcctgaaaagctttattcacatcttttgtaaaaataccgctcgacagcccaaaagtgacgctgttgttaacgacaatcgcttcttcaaggcttgccactggaatgatcgaaacaaccgggccgaaaatttcttcctgcgcaatgaccatttctgggctgacatccgtaaaaacagtcggcgcatagtagtatccttttcccggcaaaatgcgcccgcccgtaagcagccttgccccctcttttttacctgtttcgacatactggtggatgcggttgagcgcttctgtattgataaccgggccgactgccaccgtttcatcaaggccgtcgccaattttcaattccgccgttcgccgaatcagtttttcctccagtgcatctttgatctttttatggacgatgacccggcttgtggccgtgcatctttgcccgctcgtgccgaatgcgccccaaagaatgccgtccactgcaagatcgagatccgcatcatccatgacaatcacggcgttcttcccgcccatttcaagcgaagtccgtttcagaaggccgcccgcccgttcgttaattttacgcccgacttcatttgatccggtaaaagagatgagaccgatgcccggatgttccaccatcgcttcaccaatcacggaaccggagccatggacaagattgacaagcccttttgggagccccgcttcttcataaattttcacaaatgcgcacgctgttgccggcgtttccgtggctggcttccaaatcaccgcattcccggttacaagcgccggcagtgacttccaggaagcaatggcgatcggaaaattccacggcgtgatcagcccggcaatgccgaccggcacacggatgctcatcgcaaatttattttgcagctcagagggtacggtatcaccaaattggcgtctcccttcccctgccatataaaaggccatgtcaatcgcttcctgtacttccccgcgcgcttcatcgatcaccttgcccatttcgcttgtaagcgtgcgcgcgatctgttcttttctttgttttaacagttccccgactttgtataaatagtttgcgcgctcaggtgccgggacgagccgccacacgctttgcgcgcttttggcagcctggacggcacggtcaaggtccggttcggcggattgcgccacttcgcccaatgttttcccgtttgcaggatttacaaccggggcaaattttcccgttgacggttcgcaccactcgccatcaatgtaattcaaatatttttccatgtgttgttccccctttaaaaatcgagcatttgcccgattccaagctgaatggcttttttataaaccgtttctgcagccaccaggtcaaacagggccatgcctgttgatttaaaaacctgtagcgtgtttggatccggttttactttttgcgtgacaattttggaaaacggaatggttttaagccggctgtctacatccccgctttcctttgcggcatcgtgcgagtcgatatatatcgatttcaagtttttcagaagcgcatcaggaaattcgcgcatatgcggctggtatgagccaatgccaatgacaagctttccgtcgtaaaggtcttcttccggcagtacaggtgtggcagatgatgttgccgtaatgaggatatcggccttttcggcaagttcacgggcggatttggcaatatgaaccgggatatttggaatgagcgttttgaaccggcgaataaacggaggaatgttagaaggtgtccggttgaataaaaaaatgttttcgatgttgcgtgcggtgcaaacaccggcaagctgatacagcccttggtaacccgttccgataagcccggctgttttggcatcgcttggcgcaagatattttgccgccgccccgccgattgccccggtccggagcccggttaaaaccgttccgtccatgagcgttttcatggatccattcctgctgtcgacgagcagcacagcaccctgggtcaccggccggtccttgttgtccgggaaaacggagacgatttttgcgccggctgcctcatttgtgctgcacggcatgaaaaggacggagttgtcccggatggtaaaatgcgtgcgcagcggcatttgataaccgttttcttcatagatgcggtatgctttttctacagccgccatcatttcctgcatggaggctgctttgaggacatcacatccattaaggacaagcaaggccgcacctccttccttcagggatttggtaaaaatatatgtgaggcaaagcgggaacatgataaaaaggatttggcagccgaggatacagcaacttcgggacgtgggctcgcggcttttgtctgattggagggctctagtgggacaattctttgttcccgggcttatattttgtctttcatcaaacgaatgaaagaccgtttgcgtgttcatggacctgtattttgtctttcatcggctctatgaagggcagttcactgtttcccggccagtcttttgtttttcatcggctctatgaaggacaattcgtcgtttcccggccagtcttttgtttttcatcggctctatgaaggacgattcgtcgtttcccggccagtcttttgtttttcatcggctctatgaaagacagttcactgttctttggccggtgttttgtctttcataagccctatgaaggacagtttgctgttctttggccggtgttttgtctttcataagccctatgaaggacagttcgtcgtttcccggcaggtgttttgtctttcatcggccttatgaaggacagttcgtcgtctcctggcaggtgttttgtctttcatcagtcttatgaaggacagttcaccgttcatggcccggtgttttgtctttcatcggccttatgaaggacagttcgccgtctatggacctgtgttttgtctttcatcaggcttatgaaggataaattctccacggggttagctgcttttatctaattggatgctctatcgggacagttctccacggaggttcgtcgcttttgtccaattggagactctatctggacaattctactcggaggtttactgtttttgtctaattgggatcaccaacgggactgttctccctgggtgtttgccgcttttgtccaattggaacgcctaattagacatttccaaccacgttcttgctgcttttgtctaattgagctcgcctggggacaattctctccgaattgttgccgcttttgtctgatggcgtacaccaacgggacagtttttcgcaggaattgattttatttttcatcagaaaggcatatacgcaaaaacgtccaacccgtaacaggctggacgttttccagtatggagcatagcgggttcgaaccgctgacctcttgcatgccatgcaagcgctctcccggctgagctaatgccccgtgatataaagttgggaatggagcatagcggattcgaaccgccgacctctacaatgcgaatgtagcgctctcccaactgagctaatgccccgttttgtcatgatcaccgtttttcatcagcgacaatgttattatacaatgcgaaaaacgatcgtgcaactatttttttaaaaaaatattttcccgtttgccgccttgtttttccgcattgaggccggggaatactattggagataccaaaaaaggaagtggacggtatgtttcatttattttattaccgttttttacgctggccgatcattgtccggatattgaacttggcccttgctgtgatctttgcattcgggctggctatccattttgtcgagccgaaaactttcccgacggtttttgacggtatttggtgggccgttatcacgacggcaacggtcggttacggggatttgtacccggtcactttggcgggccggctgatcggcatcatcctcattttatcgggtgccggcatactgtctgcctatttcgtggcgctggccggtgcaacggctacacggcaaaacgcttttttggaaggaaaagcggcgtttacgggagggaaacaaatggtcattatcggctggaacgaacgcgccagaaaagtgatcgggcagctcatggaattaaaagagcggcagcccgttgtattggtggatgaaacacttgaatccaacccttacccttatgacaatgtttattttataaaaggaaagccgtatcaggacgagacgctgaaaaaagcaaatgtcaaggcagcgaaggcggtgctgatcacgtccgaccagcataaaacggagacggaagcagacatgggcgcagtcctgacactgcttgccgtcaaaggcttgaatccggatgcatattgtattgtggagatccagacagccgaccaggttgtaaatgccaagcgggcgggcgcggatgaagtgatccaggcaaatacacaggcaagctttgtcatgctgaacagcctgatttcaaacggaatgtccgatacgcttttgtcgttattgaaccagcaggaaaaaaatcaccttgactttattccggtgaagccgaagtggcgaaacttgacggtaaaagatttgagccggcagctgcaaaaagagcggaaaattttaatcggcatccaatcgggggatgacaccatgatcaatccgcccttggattataccattacggatgaagagcatttgtttgtcgttttggaaaaagacaagtaacaatgcaaatgcagaatccccttttgatcagccgaaagttttggcttacagtcgatccttggcgctttcctcaaatgaaaaaaagcagggctgcccattgccctgcttttttctgcattatttcaaacgtttttcgagtgctgcttttaaatcttcatagcccggtttgccgaggagtgcgaacatgtttttcttgtatgcttcaacaccaggctggtcaaacggattgacgccatttaaatagccgcttaccgcgcaggctttttcaaagaagtaaacgaggtagccaaatgtgtaggcatcggttttcggaatcgagacgaccaggttcggtacgccgccgtctgtatgggcaagcaatgtgccttcaaatgctttgttattcacaaagtcaacggtgcggccggccaggtagttcaaaccgtccaaatcgttttcttctttttcaattgtcagttcttcgcgcgcctgctcgacttttacgaccgtttcaaacaaatcgcgacggccttcctgtacatactggccaagggaatgcaagtcggtcgagaagtttgcggaagaaggatagatgcctttttggtctttcccttcactttcaccgaataattgtttccaccattcagagaaatattgcagtcccggttcgtagttaatcaacatttcgatcgttttgcctttgcggtacagaatattgcggacagccgcatattgataggcaatgttttccgctacttcagggtttgagaaatcatcaacggcttttgctgctccgtccatcatcgcttggatatcaacgccgcttactgcgatcggaagcagaccgacaggcgttaacacagagtaacggccgccgacatcatccggaatcacgaatgtttcgtagccttccgcatcagccagcgttttcaatgccccttttgcgcggtctgttgtcgcatagacgcggccttttgcttctttttcgccgtatttttcaatgagcagtttgttgaaaatacggaaagcaatcgccggttctgtcgttgttccggatttggaaatgacattgatggagaaatcttttccttccagaacgtccattaaatctttcatataggtggagctgatgctgttgccgacgaagaaaatttgcgggtttttgcgtttttctttcggcagcacgttcataaagctgtggttgagcatttcaatggcagcacgggcaccgagataagaaccgccgatcccgatcacaagcagcacgtcggaatcattttgaatttttgccgctgctttttgaatacgggcgaattcctctttgtcataatctttcggcaatgtcagccagccggtaaaatcattgccgacaccggttttttcatgtaaaagcttgtgggccaatcgaatcggttcgcttaagtatgtaatttcatgttcgttaaaaaacgcgagcgcttttgaataatcaaactgaatatgcgtcattgtccaaatcctcctgttatcgatataccatctccactttatcgaatctttacccttttcgcaaggaatgtaacgaatttctcacatttcctgcatgcataatgtttgcggattcttgccatgctattcctgtacattgaacaaggaggtagagaaatgagcattgtacaaagaattgcgttaattttcacgattattggcgcgatcaattggggccttatcggttttttcaactttgatctggtagcggccatttttggcgacaattccgcgatctcccgggtcatttatggcattgtcggcatttgcggcctgattaacctcggcctgcttttcaaaccggatgccgaagtggagcggtctacccaggcaaaaccgacgagataagagatacagccttgggaaaccgtgttttcattgttacaaaggcagtgcagcatgcctgcctttttttgtgtttttttatcttattttcctttacgcccgcttcttttttcatttaaaatgaagctataaagatgagcggggaagtgtgcagcttggaaattcaaattgttcagaaacatgcatttaacgcagtcgggagcaaatggaccggtaccttcgaacaggcagcaaacggggagatcaaaagatttttccatcaatttaagcaaaaaatggggaaaatccgtcattgcacggatcccagtgttgtgatcgggctttcctaccactcgcaggatgatgaaggtttgttttccttttatcttgtccgtgaagtggcctacatagaagcggttccggaaggcatgacagctctgactgttccttcctatacatttgcggctgcgaaatataaaggcgaagacgtgcaaaaagcgtatgccgagttgtataaatggatcaggaaaaacggctacaccgtctttcaggggcagcttgagcatcgtgaagattatccgacatcatacgaacctttaaccgatgaacccgaattgaccctttatatcccgctatatatcgaataatacacgggtaagttttcccgcgttaggcaaacgattctgcatggcacatggtttcagacagatgcaactggtaaagcgcattcagcatacgatataaaatgaacttaaatttttcgcgtcaaaatcaaccgacattgcttcttgcaacacatgtagtcatgtttcgttcaactaaaaagaagaacagtgcaggatcatcatgggtttcaaaattgatttaaatataaataataggtggaggtgggttctatgcttaaaaaaagaacggattttgaaaacgttaaagattatgcccaatacacggaatctgtggaatttctttcacaatattcctttaaaggaaaaagtttgagatttatgatatggccctcgatgtgaaaggggaggaaaaagcagctactgatgtttatgctaaattgcataaacatggagataacggtgatttttctggcttcgttttcaacattggtatacagaattgggaggaacaaaacgaacctgactgggacattccagatgactttattcctctccaaagaaatgatggcgatggaaactaacatgaaaaaatatatcgatgtttatacctaatagggacccgcttgacgaaagggacgaaaatcagccaattggtctaacggtgacctgtgcgtacaagcgatctgcatcacgcttttcatgcggcggcgctgacaagttttccgttattggccattcttcccgcttcatgctgtgtgacagtagcgggattttcggcctgatcttggcggcacggcactatgatccgtaaactgaatggtccgcgcagactgcggtatgcccggcttttttcggataaaaaaatccggacaatctatatgcccggaatcgcccgattattttttaattaaatcttcacgttttgatttttcaatccactcttttaacttatcgcgcagcgtgttgaacccttccccggactcttcagcggccttcacggcaccctgacgccggcgcggtttccttgtgtcctggtgcggtgcttcttccgtggctttaatggaaaggctgattttgccgttttcttcgtctaccgacaacacttttactttgacttcattcccgatgtggacatgatcgtgaatatctttgacatatccgtgtttaatttcggaaatatggacaaggccttgtgtctcttcatcaagcgctacaaacgcgccaaacggcttaattccggtcacttttccggtatatacatttcctgcttcataatttgacatgaaaacactcctagtattgttttttcctgttatacgcaataaaatattatatcatagtcacgggtgcctgtcattcccaaaatatttttcaggcctggccccggctggcacccagacattatttaacatttttatcgtgcccgtgtttaaaaaagttcaaaaaattgcttcagcctgccacccgcctatatgctacaataaaataaagaaatgaaatggaaaggaagtatttttattcaaaataatcgttaagggagggcgtctcatgaatagctttggcgagaagttgaaattttaccgtgaattaagcgggatgagcattgaagaactggccgtgaaagcccggattggcaagcatacactcgagcagtacgaaaccggggagcaaattccgaccacacagacgatattaaaactctccactgttcttgatgtagccgcttccgtatttttggaagcgctcggaaaaaaataattgtataagaggtttaaattcacttcacaacggctatcctaatactacaatgctttctttagtgagggcgactttcgggaagccgcactatcataagtattccccctttttttattttgcgggtccggttttccggccccgttttttgtatgctgtaaaagaagaaaacagcgccccgttcagtgtgctgttttcctgtttttggattcgcttcattgcaggccaagttgcccggtccgggatgcgcggacggccgctgcaaacggccttccttatttttttggaaattctcttgtttattggaccgtttttccaacgcgataccggtttcgagtggttgattcaggaacttccacggacggccgctgcaaacagccttccttacctttttgagaaccctcttgtgtcttggaccggcacacctgcgtctttacagggcgcgataccggcttcgagtggtcgattcgggaactttcacggatggccgctgcaaacagccttccttacctttttggaaaccctcttgtatattggatcggcacacctgcgtctttgccgagcgcgatccctgcattgagcgcccaataagggttgcgcagcatgcctctgccgaccgcaacaagatctgcttcttcgtttccgattaccgcattggcaagaaccgggtcttccagccggccgactgcaatgaccggaacgtttaaagcctctttgatctggcgtgcaagcggcacctgataagcggcgtgcgtccccgggcggccggccgcaccgatatggccctcgcctccggaactaatatgaaacaggtcaacaccggcttctttatacgccttcgaaagcgcaatactttcttcaatgccatacccgccatcgacatattcacgggctgaaatgcgcataataagtggcatgtcggcaggcatttcgcttttggcagcggcaatgacttcttttccaaataatgccaaatcctgtccgtattcatctgaccgtttgtttgtatagcgcgactggaattcatggatcagataaccgtgcgcgccgtggagttcgatcgtgtcaaaaccggcctggacggcgcggcggacagattcgccaaatttgcggacgacttctttgatttcttccttcgttaatgccttcggtgtttttgcattgtcatcaaaagggataggggaaggggcaaccggctgttttgcgtcctgtgcttttctgccggcatgtccgatttgaatcccgactttggcgccgtactgatggcacgcttccacaattttggcaagcggggcgatctgttcatcagaccataagccgagatcgttgtcggtaattctgccgtccggctccacatcggtcatctcaataatgatcaggccggcacccccgatggcacggctgacgtaatggacataatgccagtcagtggcaacgccatcttttttctcaacggagtattggcacataggaggcatgacaatacggtttttcacttcaagcgatttcagcttgtacggggtaaataaatcattcattgcaaaaccactccttacgcctgatatttttgcacctgaaccgctatgtaaatggcggaaaagttcgttccaaatataacaaaccggtgttccaaccgtcaaaacttgcgctcacagtccttgtgcgtgcaaaattctgcctgattgtgttaaaatcatcatacacttacatatctaagcgaaagaaggaatgaaggatggctcaaacgattccaaaattaacattcaataacggcgttgaaatcccgcaactcggcctcggcgtttttcttgtaaaagaagaaaatgagttgaaaaacgctgtgaaagccgcgctggaaaccggctaccgccatattgatactgcgatgatttacgggaatgaaacatatgtcggcgatgcaatccgggaaagcggcgtagaccggaaagaaatcttcattacgtcgaaagtgtggaactacgaccacggctatgaagaaacaaaagccgctttccaggcgagcctcgaccgtcttggcaccgattatttggatctttacttgatccactggccgtcaccgaaatatattgaaacatggaaagcaatggaagaactttaccatgaaggcaaagtaaaagcgatcggcgtatcgaatttccaaatccaccatttggaagatttgctggcccatagcgaagtggtgccggtgatcaaccaaattgagacacatccggaatttccgcaaaatgaactgcatgcatttctgaaacagcatcatattttacatgaagcatggggcccgctcggccagggcaaaacaaacctgcttgagcagcctgttttggttgagcttgggaaaaaatacggcaaaaccccggcgcaaattgtactgcgctggcacgtggaacgaggcattgtcgtcattccaaaatcggtgaccccgagccggattaaagaaaacagcgagattttcgatttctcgttaaccccggaagacatggaaaaaatcgcttctttgaacaccgggaaacggtacggaaggaatccggatgacgaagaatttttagcacaaacttccgtaaggccggaataaagacgggcagctgtcctctgggcaagctgcttttttaattgcttttccggaaatgataccggtttctcccggagcgcctcccatcgccaatttcttgcggctttccggcgattgattgatttttccagagatcccctttggttttgctgtacttttcatgccggctgctttttttccagcgaatgcgaagccaccatgggaggttcatgcccgccgtttcgcggggggctgcgcctgttgttttggatcttttcgcctgaacccgctggtttaaattttacgctggtttttctctgccccaaggcagcaagatcaatcatcaaaatggacgcattttccagccattggtatactgattacaaaatacgaaaggagcgatagaaattgtccatttccattcctgaaatcaaactgaacgacgggatgaccgttccggccgtcggattcggcacatacaaactgaacggggcggcaggcgtccaggcgatcgtaagcgccattgatgcgggttaccgcctgattgattcggcatttaattatgaaaacgaaggagcggtcggcgaagcggtccggcgctcttccgttccgcgtgaacagctgcgcatcacttcgaaactcccggggcggcaccatgcttataaagaagcggtccagaccattcaggaatcattgtacaggtccggcctcgattactttgacctttacctcatccactggccgaacccaagcaaagatttatatgtggaagcgtggcaggcgcttgtcgatgcgcaaaaatgggggcttgtccgctcgatcggcgtttccaactttttgccggagcatttgcaacggatcataaaagaaaccggggttgcgccgagcataaaccaggtggaacttcacccttatttcgcacaggaggagcagcgcgcctggcatgaagaacacggaattgtaacggaatcatggagcccgcttggaagagcgaaccatctgcttgaagatccggcgattcaaaaaattgctgcggcccatcagaaatccgttccgcaagtgattttgcgctggcatacacagcttggcgccattccgctcccgaaatcggcttccccggaaaggcagctggaaaacctgtccatctttgatttttcgctttctgaagaagagatgcgcgccatatccggattaagccgcccggacggcaggacttttgggcaggatccggcaacctatgaagaattttaaacccatgtaaaaaaggggctgccccaaaaccgttaaacggctgatgggagcccccttttttgatacaagcgtttatgaatttccgtcactatgcccacaagagcttcatgaattttatgagccaaataaaggggctttagggacagcccctttatctaaaacagtaaccggcccgtacagaagccgtcccggccattaataaacgatgaccggttcattctgttccaggttgtcatagacggttttcatgacacttggcggcgtgttcacacatccgccggagccgtggtggagataggcgtccatggcccagttcttccgccagcccgcatcatggaaaccgacaccgccgagcgtgaaaggtgcccaatattttaccttgacggaataattcgggttgcccgcttcactgccctccagtacagacggggactctttgtattcgatataccagaccccttttggcgtatcttcatttgtgtcatgccttcccgttacaacccgggttgtgactttcaacttgccatccttataaatccagatgcgctggtcggaaattgacacttccgcatacgtatcgccaatcccgttttcggccaggacatggtagccgacgccgatcgtgctgtacccttcgccgtaaatattgtaggccttgacggtgtccttgccgttttggaaggcgtccgcaatccgtttcgcttccgctttcgtatcgatcgcccagccatacgactggccttttacggaaatgacggagcccgcatgcgttttgaaactgaagtttttatggagcgtcgatttctccttgttcaactcttccagccgcgactggatgccggacgggtcaattgccagtttcatatctttggagacggatgcattttgaatcagttcgcttgccttgaacgggtatttcttttcctgcaggagatagttgaccgtcttgtttgagagttcttcaagcttttgcttttcctgctttacaatcctgctgttttcccggaccggctgaagttttaccgggcgcaaatgaatttcactgttgtatttttgcttgtcatatgcctttaacatggcggaaatgtcgtattgattgccgtttttgcttttcgatacgccgatttttccgtccttcatataagcctgtgcatcttttggcgcctgcagatttttattttgctgttccagttttttggaaacttcctgcttcagtgtcacattgcggtagtggtccgtccgccccggcatgatcatataatctttctctttaaaagacggaatccatgtgcgctgggttttgaaaacgcgtttaaccttcgccatatcaccgtctgtaaaacggacctttgtatctttcccgtccaccaaaactttgttcccgacatatactttatttgttaatgtcatagactttaattttttcatcgcctgttcagtggtcatgccgccgactttgacgttgttgattttgacatgcgggttaaaacgggtagcctggtaatagccggcaccgcctaaaagaatgatgacaactgccgcaatgatgccaataagaagacttttcttcctggttatggccgatcaccccaataaagtagtttatgttacaaaaagattacatcatttacatataagatatatgaatcagtccggttatacaagccatttatttcatttcatccaacgttcacaaatcatcgggaagcgcatgatgccctcccctgccttttttcccggaaacaccggcgttttagcccgcatcttccgcctataaaaaaagaaaacgctaatccgtatgcggaaagcgatttttcttcatgatttcttcttccagcttttttgcctgctcgacctgcttttcattgattttccggaaaatgaaaaacacgactaccgcaagcagcacaaaaaatgaaagtgaaatcaaagccgggatataatactttttctcctgcggaaattgaaccagaaatccgatgaggtatggaaacaatggcatctcccccttttaatcgattataacagccgaaagccacaaagaaaacggatacagcaccgcatttttcatgcggtgctggtggccaggtttccggaaagagctgcagggaaggccggcaatagcatcaacgattaacggatggtgattttttcaatgatgacatcgtgcaccggtttatcctgcaggcctgtacggacaccggcgatttcatcgacaacctccatgccttcaatgacctggccaaatacggtatggcggaaatcaagccacggggtcccgcctttttccatataagtttccacgacttcagccgggtaacccgcctgttccatctgccctttcatgccgggatcgaccgttttgctttggacgatgaaaaactggctgccgtttgtgttcgggccggcgttggccatggacaaggcgccgcggaaattgaaaagccgctctgaaaattcgtcttcgaacggggcgccgtagatgctttcgccgccggtcccgtttccgctcgggtccccgccctggatcatgaacccgtcgatcacacggtggaacgtcaagccgtcatagtaaccgtttttgctgtgcgtgacaaaattttcgaccgttttcggcgcaaaggccggaaacagcttgatcgtgatggtgcccatatttgtctgcatgtctgcgaccgtttcgttatcacgcatttccgcttgaagctgcggatacattgtgtcttctgccatatgtttgaaacctccatttgtttcactattcttgtctactttactaaaatccgagcaaaaagccaaacgttttcttttgcttctttccggctttttcaccataatggtagtaaaagcgcaaggggggaattggtttggaagttggcgataagcttgtgacaacgaaaaaaactggaaaatatatcggagaaattacgcaagtgtttcccgaccattatgtatttaaggtgctggccgtgttaaagcatcccgcccagggggatttgcaccacccgaatgaaggggatgtgccgttttttcacgagcggaaagctttggccttcggggaacaggcgaatattccgcgaaaaacggcaaaaccgtacaacggcgagattccggattatgacgcgtcattgaaaaccgctgtctgcgaactgatggaaaagcttgaaaaagaggacacactttacagccggaaaagcatcgccgcgttaaaaagtttgatgaaagaatatggcatatcacccgttggatgattttcccagcgggttttctgatggcaggggcaatgatactgttagggaaaacgtgatatccccttttttctgcggcaaaaagggaatcggggaatgcttctttttacttccttcctgtaagccgcgcgtaaatatccagtgccaaatgccgatgcccaaatccgtggatccggattttgccttccatgttctgatataccagccttaaatcagccggatgcctttgtattcgtttactttgaaaatgataggatatcctccttcatcattccctttcaaacacgatccaacatttctctgccgttttacttgataaattgcgcgtacatggcccggccggaactgtttgtggcaaaacgggcgggatccaaacttttccaaaatggggttcggatttcaaacatatactagatgtgcgggccgtcctatacaaaagtgcgtttcaagcatacgatgcaagggtaaagttcctccgtcaaaaaacggacacctttttttacaagccggttttgttgaagtttcggtgataagttttataataatatttaggtcaacgaaatatttactctatatacttttatctttttttattgcgcaaggaggcgattttctcatctgatgagccaggaaaaacgcaatttgtatattatgttcgtctgtaactttttagtaggtgccagcttaacgatgatcgttccgtttttatcgttatatattcaaacattcggccacttcagcgacagctatgtccagcgctgggccggatatatttttggcgtgacctttctggttgctttttttatgtcgccaatctgggggcgcatcggcgacaaatacggctttaaaccgacgcttattattaccgggttcggcattgccgcgagcctgttgtttatggggcttgcggacaatgtcgccactttatttttgacccggattttcatggggatcgtgaccgggtttatcccgacttccatggcgctcatttccaagcagacctctaaggaagaagccggcaaggtgctcggcactttgcaaatgggaaatgtttccggaaacttatttgggccgctgattggcgggtcgattgcagacaattttggttttaaatacacttttatgattacagccgttgccatttcgattgccgcacttggcgttgttttcggcattaaagaaaaacgttccgatccggcccggcgaaaagagaaacccgtttctccccttgctgttataaaacaaattgtcagccgccggattttgattaccgtcatggtgattgcgcttttgatccaaatggcgaacttctgcgtccagccgctattggcgctgtatgtcagccatttgacaagttccggcaatattgcgttcctatccgggcttgctttttccgccaccgggttcggcaacctgcttttgacaaggcagtggggcatgctcggcgacaaatacgggcatgcaaggattctcttgattttgcttgtgcttgcctgtgccttcatggtgccgcaagcactcgtaagccatttatggcaactgattattttacggttcctgtttggcatggtgatcggcggaatgaacccgagcattgtggcgtttattcgtctcgaagcgccgctcagcatgcaaggtgaagtgctcggttataaccaaagtttccggtttctcgggaatgtaacagggccgctgattggcggttacgtatccgtgatctccggcatttcatctgtgttttatgtaaccggggttttgttcctgttcgcatttgcgctccttctttacagtgtaaaatcagaacagcgccgcaccgtccgggaaagctaaaacggcaagatacccttttgatggtatcttgccgtttttttatttttccttgccaggtcgcgaaacttttagcttttttttggcacgaccgcaatggtacagcgcgacaggcaaattaagttttcgtcttcgtctttgattttgatttcccaaacctgggtgcttttgccccggtgcacggcctcggcaactgcggttacggtgccgtttcgttttgagcggatatggttggcattgatttcaagtccgaaacagacttctttttctaaatcgatcagcatcgcagccccgaggcttgctgcggtttccgcgagtgcaacggatgccccgccgtgcaggtatccgagcggctgtatcgttttttcattcacaggcatggtcgccactactttcccgggctccatttggacaagttttatgcccagcgcgccgatcattgtatgttccaattccatctctttccccccggttcggattgtccatacatctttcaagcctttctttcatacgatgtaaaaaatgatgatccccgcctgagaaagaaggtgagaatattgtactacaatccgtattatgttgttccttcctttccatactattccatgccttaccgccaatatcctgccgtccacccgaaaaaatttatggattcggccacgcggacgcacgaactcttggcagatgcacagcttttgcttaaccgcatttcccgctctacagcttttgccggacaactcatgtctgccgcacaaaaatcagattcagctggtgtcggccgcatgctggtgggaaccggtatccagcatattccgcgcgttttttatacaccggacggccttgtattgcagtttgtccaaaaggccccgggcaaccaggaaccttgctgcgaactccggatgaaaatgcgctggtcataacttgcggcttgtccattgccccgggatcccgcaccccaaattgtttttcataagctgcatgaaggacaaaaactaaggcttcgtgctccgaattgtccttcatcaaccagatgaaggacatttttcaaaactcaggccggtgcattgtccttcataagctgtatgaaggacaaaaccaagggctccgctccccgaattgtccttcatgttttatcatttgaacccgttccaacaaaatccttgtttcggagcttcctgcaagcaggaggcctttccgaaaaaataacccccgcttgagaagcgggggttatttttaataatacgggaatggcggatatcctccgtacggaaccggtggatatggcaccggagggtatggaaaatacgggcgtggccttaccagtgccccgccaagcaaaccgccgagaaaaccacccagaagcggtcctgcgaaaaacggggaacgtgccgggtaatgtgcatgcggatacatcaaataacctcctctccttctatttttagtgtatgcatcccagcactaccggattgggcgttacgcagacgctgacttttgcccgttcttttttttgcgtctttcctgccacaaaatcagcaaaagcgttataatcggaaaaaccacttgcatgggaaggtgaagcagaacaggcaccactttgatgccctcgtcgatatgttccgcatacgaggacgcaatcatcgatgatgcgcccagcatgatcacaccgagcggatagactgtttttctgtagctgcttacatggaacagctccgtaaacgtaatacaagccgcatataagaaaatccccactttaaaaaacccgccaacgattaaagccaccataaaaaacacatccaaccgctccagaaaatgggcaatttgaatttcctggatggtcgcaagcaacggaaacggggatcgcatcatggcatccacgccaagcacacagatattgatcagcatcgagatcgccaaaattgtgccgcttagccacatagctgacagcccggctacttttacactttttatcttatctacaagcggaaaaatggacaaaaacgcaatcgtttcgccaaaaggaatataaatcgtctccttccccattgtttttaggacaggcatgggcccgttttccagtactggtttcaaataattgagcttgacgagccctgatgaagtaatcaatacgaaactcgcaatcgccagaaaataaaagaagataaaaaagatctccccggttctggccatcacttccattcctttttttaatgcatacatgacgcacaaagccataatcaccgtgataataaaccgcggtgtttccggataagccgatatgatcagcatttctccaaagtcgcgcagcaccctggcagaaaggtacaggaagtaaatgcccatcgcaaagccgaaaaaccagccaataccttttccgtaaatcgcccgcaaccattcgaccggcgaaatgccaggataaaaggaaaatattttgtaataaacgtaaaacaggaaaaacccgacgctcaggccacttaaaatcgcaagccatgcatcctgttttgcgtcgcttccgattcccagcaaaagggcactgccaagttcaaacataaagattaacacaaataattggtacgaggaaatttttgccttttccatatatcaccaggccctgttattttaaatttgaatggaatggatttgtccgtattccagaattggcgatgacgacgtttgcatgcaccttcacatttaaatgggcaaagcccttttcattccaatggtgccttaaactgtgccactctttcgggtactggcggtaaatcatttccccgaagccgaacacatcacattggtcgtgctgcatatggcgaatgccatggttaatttgctgctccacatttttttcgtatgctttttcaatccgggccatttcctttgaatccattacatcaagcggtacattgatttcttgcagctggcccacaaggctgatgtggatatgcatttccggttttccgtttttcatggccggtttcataccgataatcgtttttcttacctgcagcccgagcgcatttggatgatgcgcccagtctaaatcaagcgaagtcatttttgtttttttcaatagccatgtaatcgtaagcgcatcctgtccgcctacccagtcaatcagttttccatgctttaggatcccgatccccccgctcgttaagtatgcgtccggttctgtctgattctggctttcctgcatctctccttttttcttatcccctatcagcttgaagcttcctactactgcttcttttccttccgttgtaagatcatataggagatctgaaatatctgtttttacccgcccgccgacatcttcttgtgcatattccaatgttttattgattttattggtaggaatacggtcaatcggagtcagcactttaaggacatcctctgccttgccgttgcgggcaatcagaacggaagcagtgttgcggaattctttatttctgtcaaaaatatcaataatcggataaatcccattttccgccgtgcttttgccaatcaggagaacgcttgtatgggaaaaatataacctcctcgaaatttcccggcctgcagcgagaaatgcgtcctcaaccgttttgccttccgtttggtagatggtgacagtggggccctgcccgccgcttatttgcatgtcgcttggaatatttaaggaattgacaatttgataggtcagcaaataattcccgttttcaagccggtcaataccgatggcgcttaccaaagcaatatccgttaattctttatggctccagcagcctgccagcaaaaaagataccgtaaaaagggcaacggccgttttccatcggcttctcatcatggctgttccccatttttagcatttttttgtttcggcggcatcggcttttggttttcggcctggcggatgatatttttctgactgaagagccgcggcctggcgctcatcgaccaaatcggcacccggatcactgtatcaccggagttagaacggatgaaaggggcaatcggcgccgtgtatggcacgccgaacgaccgcaagctggtcaaatggacagcaagcgcaatcatcccgataatgatgccataaaaaccaaaagtggccgccagaaacataaaaacaaaacggtataatctggctgaaatggcaatgaaaaaagacggggtggcaaaactggcaatagccgtaatcgagacgacaatgaccattgcgggagaaacaagcccggcctgcactgccgcctgcccgataacaagcgccccgacaatcgaaaccgtctggccgattgggcgcggcagacggagtccggcttcccgcagaatttcaaatacaatctccatcccaattgcctcgacaacagccggaaaaggaatcgtctcccgctgcgccgcaagtgcaaaaacaagctgtgtcgggatgagttcctgatgaaaagtggtctcggcgacatatacagcaggcccaacaagcgaaattaagtagctgagcacccgcaaaaggcggagcgctgtcgcaatatcaaaccgtgtataatagtcatccgccgactggaaaaattggataaaaacagcaggtgcgagcaaaacgaacggcgaaccctccacaacaatggcaaaacggccttccaataaattggctgccacgacatccggcctttccgaatggtgcattgtcggaaaaatggtatacgttttatcttcaatgagctgttcaatataacccgaatccaaaatggcatcgattttaatcgtgtttaaccgtttacgggcttcctcaaggactttatcgtttgcgattccttttatgtacatgagcgcaacatcggtccgggtcacttccccgattttaaagttttcaatccacagattcggatctttaatccgtttgcggatcaatgaggtgttgacgcgcaatgattcagtaaaaccatcacgcggcccgtgtacagtcacttcggttgcaggctcttcaatcgcccgctgttgcccgccccttgtgctgatgcttaatccgccgtataccccgtcaatcagtaaaatggactggccactcaacagctccgaaaacaagtcattccaattcatgaccttttttacaccgccaattttaatgacgtgcttcatgatgctgtcgagtatattttcacttcccaaatacccgtcgatttccggattgcccatcaagacttcaagcaggttttcattgatcattttcggatcatccaggccatcgacggaaataacggcagccggcaaatcattgccgcttccaagcatgatttgatggatgacaatgtcggaactgttcccggttgtttttttcaactgttggatgcgcgtttttaaatcggtgcccatggtcaaaaacgggatatccgttacagtcccgctcgtatcgtctccgcgcacaggtgttttctgcacgtccctgcttttctttgcacttttgttttccttttttgcagcgtttctctgctttttccaccaatatggcataccgatcctccttttcgcccgtgcatggctgtttgtaacggagcgcaaactactgatgaagatatcttgttgttagtatgtttcgattcgaaaaaaatatgaaaggaattggcacgcatgaaaatcgcttttttaaccggcattgccgcactagtcctctatgccttcattgccggaatcgatttttatatgacaagggactttatgggatctgtccatcatccgatcggcatcctcgataccttttatggtgtcgaaaaaggcgtactcctgatatgcatcatggtgcttatttttaaaatagcaatcgaggtgttgaaacagaaaggacggacacaaaaataaggcaaagaagagcgtagtgctcttttttgccttatttttaatttcagctttttagcggaaggccgggcaagatccggcctgcaccatttgccgtttcgtcttcattcgcgtgtatctgcaggcagccggagggcgctccttcgttacagcgcttcattaaaactgcggtcgtgggggcgcacgcctttcagcacattcatttcgcttggagtagcgcgcccccctttaatcctgttctgccatcttctcagccagcaaggccagtgtccgtaccattacgccggttgcaccggccgggccaagatcggtttctttccctgttatggcggttcctgtaatctccagatgggcccacgaggtgtcttccacaaacgccccgataaaagccccgttcaccatcacgccgccctctctgcctggcgaaccgttcaagtcggcgatcttgctgcttcgtgcgttttctttgtccgcttccgttaccgggaggcgccagatgaattctcctgcttcttttgcggattccagcacccgttcaaaaaaaacatcgcaattggcgacagcacccgttttatcgcggccgagcgccgggatcacacccgttgtcaaggttgcaacatccacattttggctggcaccatattgtttcgcatacgttacggcatcagcgagcatcagcaagccggtggcgccggtatcccgcacttcaatcgttttgccgttcatgctcgtgataacagcgcccgttccagtacgcatttcaccccgcccatcgtttgccgggaccacccgcggtttgcacatggtaccgtttatgctgttatcggccacgggaacgaccgccaccacgttttttgccggtttccgttccccgatcacttccatggcgcccagaacagctgccgcccctgccatgccggtgttctcacctggtgtgcaacaatcggctgcggcaccgggtccgacaagtgcgagcacattgccccattcccgtttgcccgcgtatttcaggatgaccaggatcggcggctctttggattcccccgccgcagccaaaaccgcacccattccaagcttctccatctccattttttcaaggatttccacttcaaaagggtatttttttgcaagtgatgcggcatattccgcgagacgggccggcgtccatatattcaccggcatattggcaaacgtccgtgccgtattcacggctttgccatacacgtacccgcggtgcagggcagcgcctgttgtttcttcgggggaaccgttatttttacggtatgtacccgtttgaagattggcgtttttaaccggttggccctctgttttcccggcggcattaacatgctcggcattccccggccggatctctgcttcctcggcggcactggaatggaccggcgtggcgtgttccgccggttccggttttttcccggcagcctggatgtaaaccgctactttttcgagctgcacttccggaatatttggttgccctttgtaaccggcaaaccggtatgtggccatcggaacggcttcgccaagcatctgggcggcttcctccccgctgattgcgccggcgcaaaacgtatcgaggaaaaccgctgccgtaggccatctcattttccggatgtgtttcactgcttttccaaacatccttttcaaatgttcttttctaagttctttcgggttgccaagcccgataaacaaaagccgttttactggcagtttcccgagggtgtgaatgacagaaaggctgccggcgcgtgcggacagatcgccggattttaccagttccgtcaatgccccgccgaaacggttgtccaggccgccaagcaagccgccaaactttttaggaacttgctgcaagccaatcacaaggcagtcttcccggcattcaagcggatctcctttccccagttcaaacatacaaccacctctgttccattatagccgccagcttgaaaaaaacgcacaaaaaaagcgcaaccggcgattttgcgctattcttccgtttccggtctaatatattgctgccggaacacttgcatcgttttgttttcgttcagttcagccagttccttttcagtcagggacccgtcccccattttaataatatacacatcaagcgtctgttttccccatttcttgtaaacatccgaaaccgtttcaaaatacagatcgagccggttcccttttatggcggatcctgtatcggccacaacaccgaaatcgtagcctgggatataaaggaccgtcccgattggaaaaatggatgtatcggcagcaatcgttgaatataaatcccgtttcactttcaccccggaataggtgatgccgtagccgggatggtcgggacttttcccggtcgattcggcccctgccgtataccccgttgctgtcactttctttttcgggtaattgctccagtcataggcatcaagggatggctgcggctggctcgcggcaatagcggccaatcctttttccaatgcccgagcaggtaccgcttttgcagctgctgcttttatccccgaaatggcctggaaagtggaaatcattgcccatatgaacaaaatggccatcaataagcggatcatccattttttcatgttcaattggtttcactcctcttagggctattgtttcccacgccgttccaaaatatgcgggcatatagcaaaaaaacagctgatccgtctgccctttttcgcgccgcccattctcctattctgcaaatggcgcttccaaaaagcactggttgttttatccggaaaatttgcgccggcttttgccggccggcccgcctccgatttaaaggcaaaaaaaagctgccctcaaggcagttttaaaacatccggtatccgtttttccggagcgcttttatcgcaacaccagccaaaagtgcccccacaaggccgctcgataacacgagggcatcagataaatggatggagctaagatgctccccaagttgccggaaagccgtcccgggatcggtaaaataccgggaaaaagcgatccggtcaatcatcgaaagcgcaatgaccgggtaaataaaacagagaatccaggtcatccgcaaaagcatattggcaataaaaccgataccgaaaaacaaaacaagaaaaaggaccatcgaaataatcaataccggtatactcataagcccctccgcatccccgttgtacatccagtttactgaaaaaaccgaatttcgtcaaaagtaacgcgaaaatatttttgctatataaaattaaattttcctttctttaaaacaagccttgtgccgccgatcataaacagggcacggtcatccacgacttttttcataacagaagcagaagtgcctttcagctttttgccaaacacaatgccgatcgcattgtcttccccgagggagcagacggtgcctttgtcattaaaagtgaaagcttccaggctttcttcaccgtggatctttttcaggaggttccgtgcgcatacttccccatgctgcatcgccatctgcgctgtcggcgggtacgggcggtttgtgtccttattgatgatcagcgcacagtccccaattacaaaaacattttcatgccccggaacggtcaaatccggtttgactttcacccggccgcgcaccgtttcaaacccggacgcatcaatcacgctattcccgcgcacacccgcggaccagatgacggtgccagacttgatttcgtacggctctccgccttttttgcaggcccataccccgtcttttgtcgcttttttgaccgccgtgccaatatggaactcgacgcctttgctttccaaatacgaaagggcgtaatcgacaagttcgcggtcaaattgcgggagaacgataggattggattcaatcgaaacgatccgcactttatcgcgtggaatcccgtattccttgcaaagcgccggaatccggttcaccagctcgccaagaaactcgatgccggtaaaacccgcaccgccgaccacaatggtgagccggttgtcatctttatcgttttccctccggtaggcatcgaactggcgctcaatatgttcccggattttttgggcagcgcttacatctgtaatcgaaaaagtatgctctttcaaaccttcgattccgaatgtttccgcgttggatccaagtgcaatgacgagataatcatatggtaacacttccccgccttttaactcaactgtgttcgcgtctttttttatccgcttgacttccgcctgcttaaattgcactttattcttatttaagacgttttgaatcgggtagcggacccggtcatggtgcaatgtgccggcggaagcttcatgaagccatgttgtttcgtaatggtaatcatttttgttcacgagtgtgatgtccgcttccccttttgcaagctgtttttgcagacgcgtcacggtcatgagcccgccgtaaccggcacccagtataaccactttcggtttctccatttttctcacttccatctctttattttggacaggccggcgcctgtatggcaacatcatccattatttgtgattttattcacgacaattggcacgccaaatttgtcacatgatctccatcaaattgtcacaaaaaatacatatctccacttcaatcatatgctttttacccgctattttcaattgaaaactgtactaaaataataataaaaatattctaatatataacatggtgcctaaaattttttccggacgcaggaacacctgcctgccttgcccgcagaggtttttagcctgtgcgcttgtgccaaaatgtgctatgatgaaggagaatgaagcgtattggaggggtttcgttgaaggaagatcaaaccgtttatgatataaccgttatcgggggcgggccgaccggcttgtttacagcattttacgccggattacggaaaatgtccgtaaaaatcattgaaagcctgccacagcttggcgggcagctggctgcgctttaccctgaaaagtatatatacgatgtcgccggttttccgaaagtgaaggcggctgatcttgtaaatcaattagaagagcaggcctccatgttccagccggtgatctgcacgggccagtccgcagaaaagcttgaaaagaatgaagacggcatttttacgctaacaactgataaagaaatccaccattccaaagcggtcatcatcactgccggtgttggtgcattccagccgcgccgcctcgaagttgaaaatgctgcacaatacgaaggaaagaatctgttttattttgtgaatgatatggaccagtttgccggcaaaagtgttgccatccttggcggcggcgattccgcggttgactgggcgcttatgctggaaccggttgccgaaaaagtgacgctcatccaccgccgggacaaatttcgtgcccatgaacgtacggtggaacaattgaagcaatcgcgcgttgagattaaaacaccgtttgtcgcgagcgaagtgatgggtgatggggaaaatatctcccggcttatgattgaagaagtaaaaggcgatgcgaaagaagcgcttgatattgatgcccttatctgcaattatggctttatttcgtcactcggctcgattaaaaactggggccttgagattcaaaaaaattccattgtcgtcaactccaaaatggaaacaaatatcccaggcgtttacgcagccggcgatgtttgcacgtttgaaggtaaagtgaagttaatcgtaacggggttcggggaagccaccacagcggtcagcaacgcgaaaacgtatcttgacccgaaagcccgcgtccagccgatgcacagcacttcgctgtttgaataaggaaaaatcaaaatcccggatggctgcccaaccgggatttttgattaaatattgctcttatcgccgctccggacccatttcaggacgggggcatttttttgtttcagttcttttttgttctcccatgcactgctttctgatccatccgctttggcgtctgccgcatcatccacgagccatttttttgaattcttgtcatatttaagcgtatatttgcggagggtcttgtaggaatagtcctcataatttttttctcccgtatatttgatcttttcgttataggaaacgagtgcttcaatttccgctttccagtctgcatcaaaatggttgatgctcagttcatccatatttacgacggaacccaaatactgggaagtcacttctttacataatctttaatggcttcaaactgcgcctgttcaagtgaaaagtcttccttaaaagaatcggtcgcgtttgaaagcttattggcatccagtccggaagtcgtatatacgcttagatcctcgttgaacttgcggatcgcctccaaaatccctttttgtacgttttcgcttttttgggcaaggcggctgtcatcaacaatcatgctgacttcggaatttccccataaatcctttttctctttttggaaaaaggttcccaaactgttttttaccgttacattcgtttggtaagttccgggcaaaagtgggccgtaagtatgactttcttttttttccggaactttcatatttccgattgacacattaagctggtcgttgtcgctttgcccggtcacttttaagtggacggtcttcactttcagcttatagtcggggaaaaatccccatttctttccgtcttgaacgaggctgatctgctggttcgtttccgcgtaattttcgtcctttatttggttatgaatgccatctcttatcacctgataactgtttgcattggtttttaaataccggatcatggcctgaagggaagtattgttcaccaatgcattcggattgtcggcaacaatcagcccttccagctgcttcgtatcctttgttttgaccgcattctcgaacttttccagtacccggtcaggttttgaagcctgggagagcgcgatccatataaccgcaagtacaacaatcacggctgcagctatggcaatcagccatttatgtttcgtgagttgcgccataggttaatacacctctccgcctgcaaaagcttcttccagctcatttgtatagtcattctcctgccaaaccgtccattttccgtcttttttcaccatggaaacttctgccgggtcttcagcttcttttggttccatggaactgacaatggaatcgaatttggagagggcatatttttttgctttttctgaatcgtaattttcgctgttatccaaatattcatctgcatatttttccactttttcagaaatatcgtccatagaaatggtggaataggtcaactttacgaccgctttatttttgtagctcgcaacggcttccgcatccagtttcgctttttcggcagcggccgatttataggcttcataatactttttcatatctgcatctgatatatcatcggtaatattgtcgttaaaggcttttttaaaggttttatacgcatctgtctggacagcttccttattctctgaaacatatttttcataatcggcattgtccttgtttaaataaatggtgtctatatatgcctttaacgcttttgccgggtcctgcagggaatcgtacgatttactgtattttttggtatccagcgcaagtttcaactcgtcactgtcatccccgcttttttccgtaaacggctggatgcccaatgtatatgttttgcctttttttacttttaccagtacggtcatcttttttgtattgcccgccccgatactgccgccgcgtgaagtgcccatatcgagccgggtgctgtatatgtcgtcttctatgttcacttcttcgttgccatcgtataatttaatattgctatatggagagatatggaccgtatccgaagacacatttttgatctttaagtcaacggccaggaggtctttctcaccgtcttccgaaacatccgcatcgtcatccttcaacagggcataggacgcgtctgtaattgaagcttcaattaacttgtttttattggaagatcccccttccgcttctgcttttttatctgatttcccgcaagcagccaatccccataccaatgccagaacaacaagcagcacatgccattttttcactgcagtttcccctttccaatcttcattctgcagctgataaatcgcagaatttccttaactttttatcgaacccggggtacggtttttttatgtataatgcgggtaaaggaatacataacgcagcttccccctcgacattcctttctcccccattatgcaaggaccaagttcccttcccctttttccgaaaaatccgggcaaatgagcagctaaggtatatctacccttttttccatgaataaacatatttacgaaaaagtattttatttttaatgactttgtaaaaagttgtggctttttagcgcaaggaaggcgtttataaatgcggatgtacaaacagcgaaggaaattggcgtgcccggacaggaagaaaaccggaagacaggcgctggctggattttttgaaaagatttttgtgaggcttgcgaatgaaagggactttgccaaaaaggagcttaaatcaattcagcagcgcaaaagccccgcctgtcattggcgggatatcctgcgctgctgcaatgaaatgggaaccttgctggcgtataaatatcctgtttttgcagcatcactttaaatgcttcagcatttttccggtgtgccggcttttgttttagttttaaatgaggagccgcatccgcaggtgacaatcgcattcggattatcgatcgtgaacccgccccctaaaagcgactgcttataatcgatgaccgtgccggttaaaatcggggcgctctcatgatcgacgagaatccggatgccgtgctgttcgccgaccgcatcgccttctttgatttcgtggtcaagcgacaggccgtacgacaggccgctgcagcccccgccgtttacagacacacgaaaatatgcgtcctgctcatcgttttgctccatcatgtctttaatttgaaacgcagctgcttctgtaagatgaatcacttcactcattttccgaacctcctttccttgattataaccatttacaccgtgcaaaacaatgattgcgtatctcccgggcgccgggcagtcttaaaatgcgggctgctttattttaaaattgcattgcaactcgaaaaattcaacaaagtcgctgctgtaaacgttttttaatgaaaaatttttaatcgtgcgctgcaaacgcattttccgggatatagccgtattgctccatgaccgcataaattttctttagccttggattgccttctgccaccggctcgccttcaatgacaacaaccgggtaaaacagatcttcatccatcactttttgcgcaaaagcacgcactttttgatcatcaccgggtgcaaaaatatcgatatactggatgtcaaacggctggcccgggtatttccgcgaaagtgctgctttgagccattcaaatgtatctttagaagacggcgcaccgacgcagcttgcgcatatttgctccgccccgtaaacttgaatcgtcacttttttctccatcaaacccgcacctcttccggggatttcttattcatattgtacacaacagcttgcaaaaaggaaaacactatatcccgtttttttatgatagatttttcttgtaatcctgtttataatgagaagtaagaaaggagcgatcatatgcctgcagatacaattacagaacaagttcaggaagtattggataaattgcgcccgtttttgctccgtgatggcggcgattgcgagctgatcgacgtggaagacggcattgttaaactccgccttttaggggcatgcggcagctgcccgagttccacgatcacgttgaaagccgggatagaacgcgcattgtttgaagaggttcccggcgttatggaagtagaacaggttttttaacgggcagtacgcggtttcctatcaaggaaccgcttttttactggaataaattttacttggacgggatgattctctggttattcacgcatccgtgcttgccttcactacggtccggcccggcattcgaaacctggcccgagatgtgtttcaagtgcttgctgtccttttctacaaggagccacatttttattgaatatctgcatggtgaatggttttctgaaatgctcaccatgcctgacatccacacttgccttcactacgggccgggcttcattcggaaacctgaccggagatgcgttttaaactagccggccttttctacaaggagccgcttttttatcgggctttgagccatgccaccctgggaatattgtattttcttatcggaacttccgagagctcataaaattcagccagaaatgcttcgtatgcttctgccccccgtacaattttccaaagctgttcctcatgcattttttgttctttttcggaccgggtgagaaaataggtttctacacattcaaaatagtgaaggggaaacagcaggcgcgcgaaaatgagccgccacgaaaaaggcgaaagcggcgaaagcgaaacatattgctgcaaaaacgcgcggacatcagggcggaacgtgtgtgttttcttaaaatactgcgcgcggatccactcggcaatatccctgcctgcgtggtcaaacacccagtcaaacgggtggtggatgataaatttccggccccacgtttcgtttgaaaaccgttcatggcaaatggtgccggcatctcccgggccaggcgcctcatccatttccgtatcgacgacatactggatcgcattttcacaaagccccatgtaatagggaaacgtttcggcaaacaggcgttcaaacgggtggtcggggtgctcttctactgttcggtaccatgccttttccatttgttcaaggcgcatttcccagtaatttttccattcgcccatccggtttgtttccgttatcgtggcggaaagcgtgcggccgcgcaggtggaatttcgcaagtttcctgcccgtgcgcatatttccgggcgcttttttataacggttttccagtaaaacataatcgctatccccgtctgttacgagaaatttcttttctttagatggataaaaggcggaagcatagcggtcgccattcgtcacgaggtgccgggacatttcatataattcaacaagcacattttctgaaacatttgtcacgggaacgagcgtataaagattaccgtttgcttcatagcggacctgttttccgtcaaaaaaagactgcccggcgtcaatgccgtaatattttttcaaaatggcttgtgccatcatcttccctccccaaaaaatgcattgcactttctacattatatgtgaaggaacgtgtattcttgcttgatctcataaaatccattagaatgatcatgctaaagaaaatgtcgaataattgaggtgagaacatggaaaacaagaaaaatatggatgtgtcagaacaaattgcaaggcagcggctgaaagaacggggcgtagaattggaagatattgcgaaactcgtcctgtatttgcaagagaaatactttccggaaatgacgcttgaggattgcatggaaagtgtcaacgccgttctttccaaacgagaagtgcaaaacgccattttaaccgggatccagctggatgtgctggcggaaaaagggatgcttgatgaaccgctgcaaagcacgattgcggtcgatgaatccctttatggtattgatgaaattatggctttgtcgattgtaaacgtgtacggttcgatcggttttaccaactacggttatattgacaaacaaaaaccgggcattttggcaaagctcaacgaccattccgacggctcatgcaacacgtttctcgatgatattgtcggggccattgccgctgcagccgcaagccgccacgcacacagagtggcgcacgtgcagccgtaaaaacacgaaaaaaaggcaagatacgtttttgtatcttgccttttttcgatattcgttttccaaacaaatcggactttacaacaggcgggcatatggagccttcctgatttgcacccgcgcttgtcacacttcccactggtcaagggaatcaaccgtataggtcggcaggatttcttttgtcttcaacatttccttcgtcgttatgccggtatggacgagcagggtgtcaatgcccgtgcggatgcccgccagaatatcggtatcgtaattgtccccaaccatgatcgtctcttcttttttcgaaccgaggtattcaagcgcctgctcggtaatgatcggttccggtttgccgataaagaccggcttggtttgggtcgcaaccgcaagcaccgaggttaaagccccgtttcctggtagcagaccgcgttcagtcggaagcgcaatatcggcgttagtggaaataaatttggccccgttccggatcgcaatggcgccgagggcgagcttttcgtaagtaatctcccggtcaatgccgagcacgacataatcggggtgatcggatgtgatcgtaaaacctttttctttgatggccgttttgatgccttcttcgccaatcacatatacagaagcatccggcttttcatcataaataaaccgggcggtcgccatggatgtcgtaaagacctgctccgtttttgccgggatatcgaatccgcgcagtttttcggcaacctgtgccggtgttctcgaagaattgtttgtaacaaataaatacggaatccctttttcctgcaaccggctgacaaaatcgccggcttcttctattttttccgttccgcgatacatggtaccgtccaaatcaatcaaataggctttatactttttcatgctgaaattcctctctgtttcgttgcttattcccctttaaaagcgttgaccgggccgagttcgtttgccaggtaagtgcgcacatcttccggaaaccgttcaagcgccttgaaattagccgcaagcacttcctgaagggtgccgtaatccagatccatatacccccggacaagctgcttcctgagcgcgatgacagccgtcagctgctttgccgattcagcggaaaccacattttcatcttccaaaatgtcaatgatgtcttcgtagctccccggatcgcgcataataaacccgtcaatgatcgcgtttccgacatccagaaccgattcgatgacggtttctgcaattctttccaaagcagccttttcgatttccgtctgccaggccggctgcgcttgaaacgaggcaagccgtttttccataaatgacaatatcccgtttattttttcacgatcgacaaaatacatcctgtcaccttctgcctaaaatttatcaaatggcggtgccgggcaaaacttatttggcaacgattttctttgcgacaaaataggcacagccgaaattgcagtattcataaagatattccgtgagtgtactgattctggtgtcaaaagtggatttcggatttcggtcatcaaaaaaaccgcgcagccgcagctgtccgtaaccccagtcgccgacaatatagtcgtacttttccagtatttcactatatctgcttcggaatgcttcttcattgtagccattccggtaattggcaataatctcgtacgtatggcggtggatggtgaccaatttcaattcctccattttccccgtgtgccttcctgccttattttattataacgaaaaaccgcccaaattctaagcggaacgcgaaaaattttttcagccccattgaacggaaaaactgcgcccattaaagtgcgcagcccgtttctcaaattttttgcgtctgttccacgttccctaaaatatgctttgcttttgcagcggcactgacctgttcatccgcatggtatgaagagcggacaagcggaccggattcgcagtggctgaatcctttttcaagtgcaattctttttaattcggcaaattcatctggatggtaatatttgaccactttcatatgttttttcgtcggctgtaaatattgcccgaacgtcacgatgtccacatcgttggcgcgcaggtcatccatcgcttccgccaattcttccatcgtttcgccgaggccgaccataatgcttgatttagtcggaatctccggctgcatttcctttgcccgccgcaaaaattcaagcgacctgtcgtacgtggcgcgggcgcggacccttcttgtcagcctccggacggtttcaatattgtggtttaaaatatccggttttgcatccatcaatgtttttaaactttcgtaccggccctgcaaatcggaaggcagcacttcaatggtggtaaacgggttcatgcggcggatcgctcggatcgtttcagccatcaccgctgcaccgccgtctttcaaatcatcacgggccaccatcgtcacaaccacatgctttaagttcatttttttcaccgattcagcaacccgttccggttcctgccagtcgagttcggacggcagcccggtttttacggcgcaaaaacggcaggcgcgtgtgcacgtatcgcccagaatcatgaaagtcgcagtccgccttgttccccagcattcatggatattcgggcatctcgcttcttcgcaaaccgtatgtaagttttccgtacgcattaatttcttcagtccggtataattttcattcgtattgagcttgattttcagccattcgggtttccgcaaaatctcttcctgtttgttcattttccatctctcccaccgggttcgttctctctcactttaccacattcgtcccttttttgaaaagaaaacgccaccggtttttccaatatttaatattgatgaaaatccgcttctctttccacaataagcgtaagaggattttcatattgcggtttttctgtttcgacaacattgatagaaagagggttttcgcattgcggtttgttttgcttttctgccttgtaacagggctttcattttctgcccttcatgcccaagcaaaagaaatatccgataaagaaatgtacaaaaaacggatggaactttatcagcatatggaggcatttacccagattccgtggtacaatttggcagccatcgaccagtatgaacggagcatccggtttgtccgttccgacctaccgaaaccagccggccttatttccatttattttccccctgaaaaatggtccgggcttgccaatccgaaccacaatgatacccatccgctttcgattgcgtttttcggcgggatcggaaaggacgggaacggggatgggaaagctgaccgcaacgatgatcttgacgtgctttttacactgagcgagtatttgttgcggtatggaacggatgatgatgactttgaaattgcgctgtggcattattacaaacgggataaagccgtacagctgatcacggaaaaggcgaagatttacaagacattcggcaccattcagctgacagacaaggcgttcccgatcccgcccggatacaattacagctaccggagcacatggggcgaccggcgcggctggggtggccgccgtatccacgaagggacggatatttttgccgattatggcgtcccggtacgcgcgacttgttacggggtgattgaattgaaagggtggaacaagtacggcggctggcgcattggcattcgtgatttaaacaattcgtatcattattttgcccatttaagcggttatgcaaaaaatttacatgtcggccaggtcgtcaaaccgggcatgttgatcggcagcgttggcagcaccggttacggcccgcccggcacatccggaaaatttccgccgcatttgcattacggcatatacaaagacaacggacgaagcgaatggtcttttgatccttacccgtccttaaggagatgggaatcgcttgaaaaacagcggaaataaggaacgctggagcgagcatagcgctttttatttcgtgtttttcggcagttcgatgagcggatgcgccccgtcgccgtttccgctataaaattgcgggacatcgccattatagttgcccattgcaagcgggacatcatgtgtataggtgatgacatccgatgcaaacgggataatgacctgaattttgattttgatttcaacataaatataaaaaaatgcgttgttaatgccatattcttcttttttcactttaatattggagctttcaacatcccccaccatttgaaaggtcacgggaatatccggccccatgtttccgagcagagcaatatcggtcactttcccaagcggaacggaaaaaatttcaggttttgattttttctttttcccgagcatgccgtcgtttgatatttcttcaagagacgtaatgtctccttcttccacttctttaaattggcgggtaatctggttttcaatttcagattgggtgacggctaattcccgggggtcaatcgtatccaacttgctattttttccgccactcacatggtctttgatcgcttcgttcgtgacatatgaggcgatttttttcatttccgactcggcgtaccgcattaaagtaggttttatgccttcgtcaataatgacaatgctgataatagtggtaaccgtaaaaaatgcgatggaaagcaaaagcacgtaccgcgtcggcaagggtccccgccgttttgaggtgcggaattttcgcataaaaaatcccccctgcaagcaaatgtatgtctgcataagggggattatgatcatattaaaaagcgtgggtccggattgttgtgctgaaggacattttatgctttcaggcacagtggtttgtctttcatgatctggatgaaggacatttcgctggttctcggctcatgttttgtctttcatcgccctgatgaaggacatttcgccggttctcggcacgcgttttgtctttcattacctcgatgaaggacatttcgccactcctcgcactccgttttgtccttcatcacacgggaaggacgaatgcaacatcatcttttgtgcttcaacctaatcgaacgtttaaatcatttttaacaatgcttgtttcccgatcatgccggcggtaaccccgatcttttccgcttcatgggtgaccgactcgagcggtgcttccagcaattgttcaatcgtcttcacaccgactgccctgccggcgataatatggcggtcctttagttgatcattcaacaagcccacatcgagcgcgccgcacataatatagcctttgtcgcacgatacggccagcaaggttgttttcggcagccggacagttgtcgcgataaacgtatgtcccccgatctcaacaggtgttacggttaccatttccatccgcccctttctttcatattttatgaaaagagcggtgaaaagtgcctgccagccaatgtgctgccatattacatcccaaattcgatctttggaaactccattgaccgtcgctgcttctaagaagccaggaaactgccattgattcattgctacattgctttgcgcatgggcatttcatcctactgaccatattcctgcaataacttccattccatcacatcacgcaaaaattccggcataaaataatggattttcgcctcccggatatgcgggaaaaagtcgccaaatgtatacatatcaatcgtaccaagcctgtagatacgatccggttccagcggcctgccccccacctctattttccgcaaagcatgattgaaaccgatattccggtaaataaaccggcccatgattttcccgcggaagccgagccccttcagctccagatgcggccatttcgggtcgagcgttgaaagaagtacttcctgaagtttttcgcccgtcagctcgatcagacacgggttaatcggatgcgggagaatccggtggagatcaaatttcgtgaccggcccgtgttccagactgtcaagcacaaggccggcattcaaaaatgcgcaatcggcatcgcaccattccatgaccgcatcacaaagcaggcccgcaagccggttttccttgaaccagtccgattccagtttttccggtaaatacacgagtttttgattcaataatttttttccttcaaaataataatgttcaatctcggccgcttctccgggcggttcctggaagttcccggtcggtaaagcacgggctgactgatagacgatttttttggcagccggatcgatttcaagcttgacatgcccgatataatagccgtatttgccggctgccgcaagaagcgtccgcccgtccagttcaccttttgccaacacatggtgcgtatgcccgcccaacacaaggtccacttccgggtacagctttgcaataaggcggtcttcatgaatgccgagatgcgataagacgatgaggatatccgcctctttttttaaaatattcatttgtttccctagttcttccagtggattagaaagctgccaacccagcagccggtacagtttataaaatcctgctgtcacaccggttaccccgattttgacaccgctttttgtcgtgtacagtttccgcggcactgcccactgcggccgtttcccgttttcatcgaacaggttggcaagaatcacgtcaaattgtgcttcctcatacaatgtgtctagcgcctcgtgcggcatcgtaatcccttcattatttccaatggtcgcagccaagtaccccagttgatttaaaagccggacatttgccttgcccatggtcccttctgtatacggatgccatctgtcgacgtggtcgccgaggtcaaacagcagcatctcttcattttgccgggcatgctgcgcctgtttccgctcaagaaaatgccggattttcggccagttttcaaaatggctgtggatatcatttgtatggtatatatgtaaaatttcgttcatatttggtccccttatcatcatgagggtaatctcgtcatgccgtttcatacggccgctttttatcctttatgcttatgcagtttattttaccacgattttcaaattggcgccccatgaaaaaacagccgtgcggaatccgcaagcggctgttttttctgccatcaccgtctaaaactaggctttacagcaatatatgaggggtgatttgtgggtaaatcgcacccctacgttcaaaaactctctataaccgttgatatatcaaggttatccaatcgaaccttccatttcaaacttaatcaaacggttcatttcgacggcgtattccatcgggagttcttttgtgaacggttcgatgaagcccataacgatcatttccgttgcttcctgttcggaaatgccgcggctcatcaagtaaaagagctgttcttccgacacttttgatacttttgcttcgtgttccaaagaaatattgttgtttaaaatttcgttataaggcacggtatctgatgtggacaggtgatccataatcagcgtgtcgcattcgacattggaacgcgcgccgtccgctttccggccgaaatgcaccatgccgcggtatgtgacttttccgccgtgttttgaaatcgatttggatacgatcgtggacgacgtattcggcgcaagatggtacattttcgcgccggcatcctggtgctggccttttccggcgatcgcgatcgacagcgtcataccgcgcgccccttcgcctttcagcagcacggaaggatacttcatcgtcagttttgaaccgatgttgccgtcaatccattccattgtcgcattctcttcacatacggcgcgtttcgttacaagattataaacgttgttcgcccagttttggatcgtcgtataacggcaatacgcatttttcttaacgatgatttcaacgactgcgctgtggagcgagtttgtcgagtaaaccggcgccgtgcaaccttcgacatagtggacggaggcaccttcgtcaacgatgataagggtccgttcaaactgccccatattttccgaattgatccggaaataagcttgcagcggggtatccacttttacacccggcggaacgtaaatgaaagatcctcccgaccagacagccgagtttaaagccgcaaatttattgtccgtcggcggaatgacggttgcccagtatttgcggaaaatatcttcattttcttttaaagcggagtccgtgtctttgaacacaatcccgagtttttcgagatcctgcttcatgttatgataaacgacttccgattcatactgtgcggaaacgccggccaggtatttttgttccgcttccggaatgccaagtttatcaaatgtatttttgatttcctgtggtacttcatcccacgaacggccggcatgttccgtcggtttgacgtaatacgtaatgtcgtcgaaatttaacgcggagagatcgccgccccattgcggcatcggtttattgtaaaagtgttcaagagacttcagacgaaaatcaagcatccattgcggttcttctttcatttttgaaatttcttccacaatttctttcgtcaatccgcgttttgcacggaaaatggaaacatctttatcatgaaagccgtacttgtaatcaccgatttccggcatttttttagccatcagccatcattcctccaatcctttttcgcttcttacccctttttccattgctttccatgccaaagttgcacatttgatccgggcggggaatttggatacgccgtgtaatgcttcaatatcgccaagatcttccgactcttcatagtcttttccctgcaccatttccgagaaaatgtgggaaagtttcagcgcttcatcgactgtctttcccttgacggcctgtgtcatcatggaggccgacgccatcgagatggaacagccttcaccggtaaatttcgcatcccggatgaggccgccctccactttcatcgtcaaatggatccggtcgccgcaagtcgggttattcatgtcgactgtcaggcttccatcttccaaactgcccctgttccgcggatttttataatggtccataatcacactgcggtaaagcgcatcaagattagaagacatttgtgaaatactcctttgctttgacgataccggcaacaagtttgtcaatatcttctttcgtattatataaataaaagcttgcgcgtgcggtcgctgtcacgtccagccatttcatcaacggctgcgcacagtggtgccccgcgcggatcgcaattccttccgcatcgagaatggtcgcggcatcatgcggatgcacgttttccagattaaatgtcacaaggccggcgcgttcgtctgcgctttccgggccgtacaccgtaatcccttctaattcagaaagctgcccgaggcaataagcacttaaatcctgttcatgcgcggtgatttcatcaagcccgatttcttcgagaaaatcgatggcttccccgaggccgattgcaccggcaatgatcggggtgccgccttcaaacttccacggaagttccttccaggtggaatcgtacaggccgacaaaatcaatcatttcgccgccgtactcgagcggttccatctcttcaagcagcgcctttttgccgtacaggacgccgatgccggtcgggccgcacattttgtggccggaaaatgcaagaaagtcgcagtcaagatcccttacgtccactttcatgtgcggcgcaccctgggcggcatccacgaccatgtaagcaccacggctgtgtgcaattttcgccatctcttttaccgggttaatcgtgccgagcacgttggagacaagtgctgctgccactatcttcgtccgctccgtgaccgttttttccacatcttcaagccgcagcgtgccgtttttttgcatcggcacatatttcaaaacggcgccttttcttttggcgagctgctgccacgggatgaggttgctgtgatgctccatgtaggtaatgacgatctcatcgccttcctgcacttgtgcatcgccgaaactgtgggcaacaaggttcagcccggctgtcgtcccttttgtaaaaatgatttcttccgttgattcggcaccgataaatttgcggactttttcgcgcgcgccttcgtaatggtcagtcgcttttgtcccaagcgtatggacgccgcggtgaacgttcgaattatattcacggtagtattggttgacggcttcaatgacacggagcggcttttgtgaagtcgcagcactgtctaaataaacaagcgggtggccgtttacttcctggtccaatatgggaaactgccggcgaacttcattgatatccattatctgactttcctttcaatgacttccgtcaattgtttttttacactttcgatcgggagctgtgtgacaaccggtgcaagaaagccgtggatgatcagcctttccgcttcatttttcgaaatcccgcggctcatcaaatagtaaagctgaaccggatcgacacggccgacagatgcggcgtgaccggccatcacatcatcttcatcaatgagcaacatcgggtttgcatcgccgcgcgctttttcgcttagcatgagcacgcgcgattcctgctcagcgtccgatttgctcgcgccgtgctcgattttgccgatcccgttaaaaatcatcgtcgacgcgtctttgacaacgccgtgttttaaaataaagctttctgtatttttcccgaagtgggtaatgcgcgtcgtaaagttttgcgtctgcttgccgcggctgaccacaaccgttttggaatgggaaacggatccgtcgcccacaaggttggtcgtattatctgaaatcgtattgccgtcgttcatcatgccgagcgcccattcaatttgggcatcgcgcccggtgtaaccgcggcggttcacatatgtggtgaccccttttgcaagcgtatcaaccgcgccgtattcgatctttgcattggcgccggcaatgacttccgttatgatgttcacaatgcctttcgcgccatcgtttgccgaaatatagttctccacataggtgacggcactgttttcttcggcaaccaccagcacatggttgaaaagcggtgccgtttcatggtcgtgcacataaatggcctgaaccggttcttcaagcacaacattttttggcacatataagaatgtcccgccgttcatgagtgcagcatgtagtgccgtcaaacggtgttcatcgactttaaccgcctctgtcatgaaaaatttttggacaagctccggatgtactttgaccgctgtcaatatatcggtcaaaatgacgccttgtgcttttgcgctttccgacaaggacagataagccggtgtctggttatgctggatatacaaattttgcttcgcgttttcgagatccacgagcgccttcactttttccggcaattcgttcaaagcgctgtaggttgtgctttccacgctaaaatcggtaaattgcgtaaagttccacttgttcagttttgtcttgtccacttccggaagcggcaggacctgggcccgggcgaatgcctggaggcggaactccttcagccattccggttcaccgttttgttcggaaaaggtgcggacatcttgctcgttcattgctaatttcgtttctgtcatcaagtctctcgccccctgcttaagcttcctggccgaccgtttcgtcttcgatgccaagttcctgtttaatccattcgtagccttccgcttcaaggcggtttgccagttcaggaccgcccgatttgacgatgcgcccctgcatcatgatgtggacagcatccggtgtaatatagtctaacaaacgttgatagtgggtaatgatgatgcatccgaaatcttcgctgcgcatcgagttgatcccttttgcgacaaccttcaatgcatcgatgtcaaggccggagtcgatttcatcgagaatcgcaattttcggttcgatcatcatgagctgtaaaatttcgttccgttttttctcaccgccggaaaagccttcattcaaatagcgttgcgccatgttcgtatccatttcaagatattccatttttttgtcgagttcgcggataaatttcatcagtggaatttcattgccttcgccgcggcgcacgttaaccgccgagcgtaaaaattccgcattcgtcacgccgctgatttcgcttgggtattgcatggcgagaaacaggccggctttcgcacgttcatccacttccatttccagcacattttttccgtcaagcgtgatggtcccctgggtgacgatgtatttcggatgccccataatggcagaagacagcgtcgatttccctgttccgttcgggcccatgatcgcatggaattcaccgctgtttacttcaagattgaccccttttagaatttcttttccctctacttcgacgtgaagatcttttattacgagttttgatcctgccataaaaaattcctccgttatttgtatattcagttccaatttattctcaatttattctcattattattttataacaaatgaaaactatgcgcaactagtaaaaacctgtggataaccatggcatgccatcttttttccgcggttttccggccttgcttattcattaatcatagcacaaaatgtacccggcataaaattcctgatacagatttcttgaatttccctgtattgcacattggaaatccggcaagctgcctgaaacagcataaaaaaagccgggatttgttttgcaatcccggttatgctgtgattctcattttcagcctgttatttgataatcaggcggatttggccttactttttggtgcaggttgcggggttcctgcaagccaaaacaaagattccagcagcaaaaaatggcggtacgtgcccctgtaccggagttcgcccattttcagaaatgtgccgaggcgcgcgcggcgggaaaggagctgttcgaattgccggagcgccatttccagttcaaaatcggcattgccggtttcaagctgcacgcatcgctccttggaaaaagcaacgaggcagcattcgtccccatcacggaataatacggtaacaggcaccgccggcagcagcatccgcaattgttttttccgtgccaggctattcaggaaaaattggatggtctgtttcatgacaacacgctccaatcattatttcctttccctattctgcacagacgctgctgatcctgctgaaatcgttcaacaaatcgtgcactttcccggctgattttggcggccatgctcgaacggtgtctgaaaaaagttttttctgcggttgaacggcgtttccgcgcaaaagccctgccatttttttcgccattcaagcggggtttccgtttatgaatgcccacaccggattggtttgcgctgttgtctcattaaaaagaagacaatttttcaaatagtgacgggacggattgaaaagcgtacactttgtctattactttcccgtttttgagcaggagcaggcacggcacgctttcgatctggtatttttccgccatttgcggcacgtaattcagattggctttggcataaggaaatcgggggacagcctgttctgcaatctccagcatcctccccgccagctggcatgtaccgcataatggcgtgtaaaagtacagggcaagtttttcttcctgcaaaatccgttcctccagttgtttttcctttgtccagtcttgcatcgtaatccatcctttacacaaaaaggcaccgcagcttggtgtgcagtgcctgttatttttatgcttcgttgatcatttcctcgtactgttccgccgtcagcaaatcatccaattcagccgggtcggacggttcaacgacaatcatccacgctttttcgtacggggattcattaacgaattccgggctatcgcttaaatctgcgttgaccgcaacgactttgccgctgaccggcgcatacagttccgataccgttttcacggattcgacactgccaaacggttcttttgccgtgacttcatcgccttcttccggcagctcaacaaatacgatatcgccgagttcggcctgggcaaaatcggtgatgccgatccggacatgaccgtcttcttctttcacccactcatgatcttccgtataccgcagttcctcaggtaccgccatctcaatccctccgttatgtatccgtaatagccttcagttttaaattaccgaaaaacagcgcttaaatcaatcactttttcagcaatttttcatacgcatcctctttaaatccgaacacggcaaaggcatcgcctgcaagaatcggccgtttgatcagcatgccgtcggaagccagcagttcaagcgcttcttcttcgctcatttccgggatcttgtctttcaaaccgagttcgcggtacttctgcccgctcgtgttgaacagccttttgatcggcagcccgcttttttcataaaagtccttaagaagtgcttttgaagggggattttcgacaatgtgcaccgcttcataggcaacgtcatgttcgtccaaccattttttcgctttccggcaagtcccgcatttcggataccaatagaaagtaagggccatttttgtccactcctgtcatcttgtcttatctgtatgttagctgatttttcccggcgatgcaaaagaaaagggactccggccgggccggaaatcccttcttttattacagcacatagcgttctgcatcgatcaatttatccgcggcttcgcgttttttcgcaatgacattggttggcgtatggcgcgtcagcttgcggagggcggaaagcgtcatttgcagctggtcgccttcaaggcaggctgcgagcgattcttttgcaatttgttcgcattgattgaacgcttcctgtgtgaaaatttgggtatacagcagtttttggttctgtttttcggcaccatctttgttgattgctttttccgtccgaagcacgcacgattctgccgcatatatattcgaaacgagatctgccacgttggcaagcagttcctgttcgttttcgaattttttgccgtacgtttgcaacgcagtgcctgcgacgagcagggcgatcttcttcatgttgcggacgaggtatttttcctgttcaagcggcgcgtcgccgacttgttccggcatcatcatcatgagttcttcctgcaggctttgcgctttttgtaacagcggcagttccccgctgaacgcttttttcacgtatgtgcccggtacgatcaggcggttgatttcgtttgttccttcaaaaatgcggttaatccgggaatcgcgataggcacgcgagacttcgtattcgtccataaagccgtaaccaccgtggatttgcaccgcttcatcaacaacataatcgagcacttcagaagcgaagaatttgttcagcgagcattcaatcgcatattcggcgatcgcattggccactgcccgcccgtctttttcttcttccggtgtaaagtggctcattctttcatcgaacaatccgactgtccggtagacggagctttcggctgcatacagtttcgatgccatcgtgccgaatttttcttttgtcaggttaaactgcgagatcggtgttttgaactgctggcggccgttcgcatattttaaggcgatttcaagcacgtgtttgctggagccgaccgcgccgacgcctaatttataacgaccgatgtttaaaatgttaaacgcgattttatgccctttgccgatttccccaagcacgttttcaaccggaaccggtacgtcttccaggataagcgttcttgtggaagaagatttgatccccattttcttttcttccgctcccgttgaaacgcccgggaatgtgcgttccacgataaaggccgtgaacttgtcgccgtcaacctgcgcatacacggtgaaaacatcagcaaatccggcgttcgtgatccactgtttttctccgtttaaaatataatgcgtgccggcttcgtttaatcttgcaaccgttttggcgctccgtgcgtccgagcccgagcttggttccgttaaggcataagccgcaagccattcgccggttgcgagtttcggcaaatattttttcttttgttcctcgttgccgaacaaaacgatcggaagcgaaccgatgccgacgtgcgcgccgtgggaaatggcaaaaccgccgacttttgcgagcttttcggaaatcagggcggagcttactttatcaagggcgagaccgccgtattcttccgggacatcggcgctcaaaagcccgagttcgcctgcttttttcaacaatttgacagagcggtcaaattcatggttttccagatattcaatttgcgggaccacttcattgttcgtatagtcttccgccgttttggcgatcattttttgttcttctgtcagctcttccagcgtaaacacttggtccggtgtgatgtcctcaattaaaaaactgccgccttttacaaatgcatccgttttgtttgccatttacaattcctctcctttttatctataatgatcggccgcagatgtgctccgcggctcttatttccattaataacgattcaacaggcggatccggctccggcgttttgcctttagaaacagctgatccgctttttaccatggtccggtgttttgccgttcggaaccggctgctctgcttttggccccggcatctatccatttcatgatccggtatctgacgttgctatttgaaaccggctagccgcctggttcggctcactgcaatcaggacacgagctcaaacacacctgctgcacccatgccgccgccgatacacatcgtgacgacgccgaactgcacgtttctgcgcttcatttcatgggcaagcgtcaaagtcagcttggcgcctgtgcagccgagcggatggccgagggcaattgcgccgccgttaacattgacgatgtcttcattaaggccgagctggcggataacctggatggactgggaagcaaaagcttcattcagttcgaacaacccgatatcctcaaggctcaaccctgccagtttcaaagctttcggcacggcttccaccgggccgatccccatgatttcaggcggcaccccggcaacggcgaacgagcggaatttcaacagcggcttaagcccgagtgattcagccttttctttatccatgagcattactgcagccgcgccgtcgcttgtttgcgacgagttcccggccgttacggttccggttaccgagaatgccgggcgcagttttccgagcgtttctacatttgtatccggccggaccccttcatcctgcgaaaagacgactttcttttcaacaagtttgttgtcttcgccgaccgaacgtaatgtgacctcaaccggcacaatttcgtctttgaatttgccttctgcaatcgcttttgccgctttttggtggctgcgcacgctgaaggcatcctggtcttcgcggctgacgccgaattttttggcgacttcttcggccgtatgccccatgcccatataatattccggcgcagtttctgcaagtcgtacattcgggcggacgacatgccccatcatcgggacaaggctcatcgattccgcaccgccggcaatgatcgtgtcagcgtggccgagcatgatcctttcggcgccgtaagcaatcgcctgcagcccggatgagcagtagcggttgatcgtaatcgccggcaccgtatccggcaatcctgctaggaccccgatattgcgtgccatattgagcccctgttccgcttccggcatggcgcagccgataatcaaatcatcaatatttccttcatagttgccggcgcgttttaacgtttcttttacgacaagtgcacctaaatcatccggccgtgtttgtgcgagcgtccctttttttgctttgccgaccggtgttctcgcccctgcaacaatgacagcttccctcatcacattcccctctttccgtgtttttgtaaaaggccccttcatcaccgcatggggtgatgaatcggggttttcccatatacagccgctttccttgggagaacccctttatgttgtatgcgaaaaatttggacggaatcttttcctgccagaggatcggcattcgccaatccgtgtggctttaattccgtaacggttttccttttaacagcatgtgttgcatccgctgctgtgttttcggctgtgcaatcaggctcaggaacgcttccctttccaaatcgagcaagtattgttcatccacttttgtcccgaacggcactttcccgcctgaaagcacaaaggcgatctttttcgcgatttcaaggtcatagtcggaaatatagcccgacagatgcatttgctgtgccccgagcaacagcgccgcataaccggattcacctgtgaccggcactttttcgcggacaggcggtttgtaccctgcgtcagcaaggcgtagcacagcctgttttgcatcataaatcagatggtcctggttaaagctgacgccgtccgtccggtcaaggaagccggactcgcgcgcttcttcagcagaagtggacactttcgccattgcaatcgtttcaaataccttgttcacgacattttgcaagtcaaactgtacgccttccggaatgtttttcaaatgcttgatgtacagctctttgttaccgccgccgcccggaagcaggccgacaccggtttcgacaaggcccatatacgtttcgcttgccgcctggatatgcgccgtatgcaggcacacctccgcgccgccgcccaaagtcatcgcaaacggtgccgcgacaaccggtttttggctgtatttgatcttcatcatcgtgttctggaactggcggacgaccatgtcaagttcaaaaatattgtcatcctgcgcttccatcagcatcaaagcaaggtttgcgccgacacagaagtttttgccctggttgccgatcacaattcctttgtaatgcttttctgcttcgtccacggcataattgatcatttgcaaaatgtcgagcccgattgtgttactctttgagtggaattcaagcagcagcaccccgtcgccgatgtcgattaagcttgcgccggcattttctttcagcactttgccctgcgttttcaaagctttgagattgatttctttcggattggctggaagcggcttgtatgctccgttgtcatagtacgagacaacgccgttttcttctttgtaaaaagacgtgaagcctttttccagcatgcctttcacccagccgggcacttgaaggccgtcctcttccattttttgcacggatttttcaacgccgattgcatcccatgtttcaaacgggccgaatttccagccgaagccccatttcatcgcctggtcgatggcgagaatatcatcggcaatcacgcctgaaagttctgccgaatacacaaggcaaggcgcgagaatattccagagcagccgtccggcacggtcatccgcatacacaatcgttttgattttattggcagttccttttgcctgccgggccgcttccaaagaagccgctttcattttcgtgcgttcgccgtattccagcgtttccggatttaattcatagatttcttttccctttttttcataaaagcctttgccggttttgctgccaagccagccgttttcaacgagcttgtgcatgaatgccggcactttaaaaacttctttttcttcgccttccgttttttcatacacgttattcgcaacatggacgaacgtatcgatcccgaccacatcgagcgtccggaacgttgcgctttttggccggccgatcaccgggcctgtcacggaatcgacttcgccgaccgtgtagccgcctttcatcatctcccgcacggtgacaagcaggccgtatgtaccgatgcggttgccaataaagtttggcgtatcttttgcaagcacgacaccttttccgagcacatcttcgccgaactgtttcataaatgaagtgacgtccgggtcggtgtcagcggtcggaatcacttcgagcaatttcaaatagcgcggcgggttaaaaaagtgggtcccgagaaaatgctttctgaaatcttcgctccgcccttccgccatcgcttcgatcgaaatgccggatgtgtttgagcttacaatggttcccggccggcggaagcgttccactttttcgaatactgattttttaatatccaaacgttctgttaccacttcaataatccagtcggcttctttcagccgttcaagatcgtcttccaggttgcccgcttcaataagcgccaggctctttttcgatgtaagcggggccggtttctgttttaacagcttctgcagcgcagactggctgaagcggtttcggacggttttgtcctccaatgtgtacccctttgctttctctgcttccgtgagtgcattcgggacgatgtcgagcaaaagtaccggaatcccgatgtttgccagatgtgcggcgatgcccgatcccattacaccggaaccgatgacagccgctttttgaatggtataccgcatagtgcatcccctttctttttgaatgaatgctcattcattaagcgcttaaaaaaataacgctttcatctttaataataatatatacgaattttttcattctatcaatcacttcatctcaaaaaatcgccattttttaaaattttttatatgtctagccgttttgggcaagctaaacgaaaagcgtggggaggtgaaccaatggcaaagctaaagaaaaatccgtcaaaagcgggtgtgagcgcggcaagcgtaaaaggcaatgccggtccgacagtggagcgtgacggcggcggaaaagtaaacagccaaaacaaccagtacaaaaaataagcaggcggctgcataggatccgcagctcattcaaacaataaaggaagacttggataaaggaggaaatggaatgcaacaacagcctttttcacagcagcaaaacgggcaaacggtttacaacgccccacccgatgtcatgtcaacaaaagatttggcctatgtggatgatatgctggcctggaatctgctggcgatgaaaaaagcgcatgatgcggcaacgcgctgccaggacaatgaattgaaagctgtttttgaagcatgcgggcaaatgcaccagcgccactacaaccagattttgggtcatttgaaaagccacttgcaataacaaaaacgaatgccagcccgccacaaaaagcgaaccctgcttttcccgttcataaagggcatgcgttcgcagccggaaaggggcaggtaccccgctccggaatgcgcgcacagctcgggccaaagaaaaaagcaggctgtccgtccggggcaaccgcacttcccggcctgaattagccgccccggcagccgggcttaatggaaaaagaaaccgccccgctcgagccctagcaggcgaatctgcacggggctcgcggcagagatacctaaatgcggaacgcgcataatacgaccattttaaaaaaggaggtacaacatttggattcccaacaacagcagcagcaaaaaattcaaaacccgaagacacaatttcctgaaacaccagaaatgaacgaccgcgatcttgccaatgacctgctttcgatggaaaaatatatgaccgcttcttataatactgctatgaacgaagcgagccacgaaaaactgtatcgcgatcttctgaccatttttacggaaacgcagaatgagcagcgcaaattgtatgagacgatgttccaaaaaggctggtacagtatggaagcggcagaacagcaaaaactgcaacagtcttaccagcagcaccaaggctacgcttcgcagttcccgtacggcggtcaggtgcaatagccgcaaaaaacaggcggcacgatgccgcctgttttttatttttcgttagaaaacatatattttctgtaatgataacggattgaaaaaataaatccgaccgcaagcatattccccatcagcgaactcccaccgtagctgataaacggcagcgggatcccggtaatcggcagcacctggatcgtcatgccgatattttcaaacacgtggaacgtaatcatcgcaatgacgccggcgcaaatgtaggaataaaaatcatttttcgtctcaagccctgcttttataatatggtaaacaagcataaaaaacaggccgataacaatgctcccgccgataaagccgaactgctcgccgatcacgctgaaaataaagtccgtctggttttccggaaggctcacttcagttgtgccaagcccctttccaaacgtctggccggaaccaatggccaaaagggactgaatcaggtggtagccgtctgtattggaatagttataaggatcaatccaggcatagatccggccaaactggtacgaacggacgccaagatatttttcgagaagtgccggctgccagaggacaagataaaaaatcaatcctgccagtgccgcgccgctgctaaaaatcggaagcaatagtttccatgtgatgcctgacacaaatacaagcccgaaaaatatcgcaataaacacaagtgacgttcccaaatcctgcccaatggtcaacatgagcggcacaaacaagcagatgccgagtttcacaaacagccagaaatccgattttactgaccggttcagcactttttcattatgatcggaaataaggcgcgccattgctaaaattaaaaatggcttcatgatttcagaaggctggaatgtcccaattaccggaaacacaaaccagtttttcgccccattacgctccggggcaatgctggctggtgccaggatcagcaaaatcaacagcaaaatcccgaacccgtaaccgtaccacgatatttttttcagctggtcggagtcaaggcggatcaccaatgcgataatgatcgcgccgaccacatagttgatgacttgttttatcagaaagctgctgtcagccgtataaatggcaacaaggctgacaatgcagaacaacatcagcgttaaaaccagcccgtaatcaattttagaaccttcatcccgcgaagacaattccatcacctgacttctcaatgccggaaccgccggccgtaaaataaaataaatgatacggatccttcaaaacaactgacccccatcattttttcatacaagctttattatacatcatacgtgaagaagcacaatccttttcgttttggaaatatttctttggcaggttgaaaaatgttgaaattcctctgccgctctatatacaataagaaagaatgatgaaaggatggagatggtctggagtggaagcgattaaaagtgcggaagaatttaaaacggtaacgggaggagaagcaccggttatcgtgaaattttatgcagattggtgtccggattgcaaagtgatgaatctgtttattggtgatgtgatcaaggactatccgcaatataaatggtatgaaatcaacagcgacgcgttccgagcgattgcggatgaaaaccaggtgatgggcattccgagcctgctagttttccaaaacggtgagaaaaaagcgcatctgcacagtgcaaatgcaaagtcgccggaagaagtacgcgaatttttaaatcatgtcgtattgtaaaaaaaggacccggagccggggaaggcgttccgggtcttttttaatacgttgtcagtttcagcacttcctggagtcgataaaggacttttaacaaataagtggagaagccttcgtgttttttgtacgggacggtaaaagcgccgtcttcattgttccacagccgcccgaagtaccggcggatctcttttgtgatggccgcatcattccgtgccttcacaaataaatcggtctccaaattataatcgtccaggttgcgaagcgttaaattggtcgacccgccgaaaaagagcgagcggccgggcttttcaatccagaccagcttcggatggaattgctcgagcccggtattataccagcggattttgatctttccatccgttttctttacgagttcctgtgtaacaggctggttgggaagcccgatttttttatgcccgaacgcgtttaaattcgggtcgaggataagccggatgcggacgccgcgggaagatgccttctcaagcgcacggaccactttccggtcagccaaataaaacatcgccatcgaaatcgaatcgcctttttttgtcgccttgatttctttcatcatccggtcgtaaactttcccctccgttaacagctggacggcaatcctgccttttcccctttctttccctttgtattgcggcagctccgggccgtccgacatatcggaagccgcctgctccgattccagaacatcccgaatgaccggcccttttacaagaaaagcgatattggaatgccagccgcttgcgtcatgcgggttgccggatgcaatgaccgttccgttttcagtcgtaaacgttttgcggtggttcgctttaatattaaaaagttcaagatacgagcggagcgtcatcttcggcgcattgtccccgaaagcatttggcagccagccggtcccgccctggccgaaccactggaaaaacatatgccaaatgccggaataaagcggtgtcgggtcacgcagcgagtccaaatgcgtaaagaccacacggatgccatgttcctttagccgttttaaaatgccagcttcatgggacccgtaagaagtattgatcggatcggtgatgacgatgatgcggataccaggttctttttcttttttggcaatcagcctgtccgcgagcctctcagcaagcggcggcactttcatcttttgatcatggtagccgttaaaaaggaagagatcggcgacgatatattgatgggcttggtcaatcatccggtaaatttcaggatagacggtctgctccacctttctttttcctgtccccttttcccggtatgttaaatccgaaagaaaacggatgtcttgatcgtgaacgttatatgttctgccttcataggaaatcccttttggaagcggcttatatgtatggtacagcatgacagccgcataaatggcaattaagacaagcaacccataagacagccatttctttccgctttttttcattataaccctcccgttttcctgtatctttcccttacaccacgcctggcaaacatgcaggcaagcgtttgaaaagcaacggaacgggtaacataaaagtactttaatttagaaaggaaaaggctatatgatctggacaattattgggattttgctcgtactttggattttaggcattgtttttcacatcgccggcgcttttgtgcaccttctgcttgtcatcgccgccattgtgctgctgtttaaaattttttcaggcatgcgcggaaataacagccgatagaggctgagggtatagatatataaaataaacttaagtttttactcaagcccgagcaccaatttgcatcatgactactttttacagtaggcaacagagctaaagaaattttgttcattttatatagaaggttgagccgcaccaaaggctttaaccttctttttttaggcaaccctttctttatccaatattccttccgaaagctccgctctttttctaagcgatgcatcaagtactgcaattctatcctgtatctatagaagatgccggaaaatactggcgcatttccgggtttaaaggtataactataatggagataggctagcccatttctatccggctctagaacgaaaagacaaaggagtgttgtaaacactgtgaagaagatcatccagttttgcctaaacaacaaatttgccatttggctgatgaccctcattgtggcgggtgctgggatttatgccggcatgaatatgaaaatggaaaccattccgaatatcgacgcgccatacatgctggtgacagcctctgatccgggtgccacaccggaagaagtcgaaaataaaattacgcaaccgatcgaacaacggctgaaaaacctcaccggcgtcaatacggtctccacttcctcgacggaaagcaattcccagatccagcttgagtataaatatggcacggatatggatcaagcgaaaaaagacatccaggatgcgctcgaaaaagtggacctgccggataatattgacaagccgtccgtaacaaggatcagcatcaatgattttccgatcctgtctttaagtgtgtcggataaaagccggtcttttcagcacttaacgaaaattgtcgaagaggatcttgttccaaaactgcagagcattgacggcgtgtccgatgtgcaggcttccggccagtacgtgcaggaagtccagctgacctttaaacaggacaagttgaatgcactggggctcgatgaggacactgtcaaaaaagcgatccagggcgcaaacgtttcggtaccgctcggcctcatcaacttcggaaaagaaaacaaatcggtagaaatcgatggaaacgtgaaatcgctgaagcattttgagaatctgaaaatcccgtacaccccgaaaacgggtgcagcttccgcttcgtccgcagccgcgcaggcttcaggggcacaatccccaaatgcggcgcagacttcaggaacgcaggcctcgggtgcgcacgcttcaggggcgcagcaaccggcgaatgccggaacgcaagcgacgcaagccaacgtcggtatgccaaccgttgcgttaaaagagattgccgatatcaaagttgtcggcaagcatgaatcgatttctaaaacgaacgggaaagattcaatcggcatccaaattacaaaagctccggatgcaaacacggtggatgttgccgatgcagtaaataaaaaagccgcacagtttaaagcggactataaaggcacacaaatttccaccattctggaccaggcaacacctatcaaagactccgtcaaaacgatgttcgaaaaagcaatcatcggggccgtatttgcgattgtggtcatcctgctgtctttgcggaatgtgcgttccaccattatcgcggtcatctcgatcccgctctcggtgctgattgcttttattattttgcaccagcttgacatcacattaaacgtgatgacactcggagccatgacggtggcaatcgggcgcgttattgatgactcgattgtcgtcattgaaaatatctacagacgcctgacgttgcgggaagaaaaactgcgcggaaaagcgctgattcgtgaagcgacggttgaagtttttaaaccggttatgtcttccacgatcgtaaccgtcatcgtctttgtcccgcttgcacttgtgagagggatggtcggggaactgttcatgccgtttgccctgacgctaatttttgccttgctagcatcgcttcttgtggcgatcacggtggtgccgatgtttgcccattcgttatttaagtacgggctgaagaaaaacacgcggactacgaacgaagggcacggccggatcgctttattttacaaaagaattttgaactggtcgctcaaccataagctggtcacgttcggcatcgcatgcctgcttcttatcggcagtttgtttttaatcccgcttatcggcgtcagctttattgaaaacgaaggccagaaagtcgtgtatgccacctatgcgccggaaccgggggaaaccctttccgatgtgaagaagatagcaggaaaagcggaggattacttaatccaccgtaaaaatgtaaaaaatgtgcaatattccattggggagtcggctttcagcaccaacagcaactccgccatctttgttgtcgaatatgaccaggataccaaaaatttcgaccgcgaaccggaaaaagtcattaaagccctgcaacaaaggacggaccagggtacatggaaatcacaggacttcgcatctatgtcgaatgatgatttaacgatgtatgtctatggcaacaatctggatgaaatcaaaccggtcatccataaaattgaaaaagtcatgaaaaacaacgacaacttgaaaaatgttgaaaccagcctttccgaaacttatcagcaatacacgcttgtcgccaaccagaacaaactggctgctctcgggttaacagccggccagctcggaaccggccttgcgcaaaccggcaaccggaccgtgcttacaaccgttgaaaaaggcggagaagaattaaatgtttacgaacagaacaaaaccgggcattacgacaatattggcgatctgaccaatcaaaaagtcacgtcgcccctcggcacaaaagtagcgctaaaagatgtcgtggacgtgaaaaaaggcgaaacaccggatgcagtctcgaaacgggacggcaaaatctatgccagtgtaaccggcaagatcaagacagctgacgttgcgaaagtgacacaacaagttcaaaacaaagtggataaactcgatattccaaaatacatccatgtcgaaaccggcggcgtaacggaagacatcaatgactcgtttacaaagctcggttatgcgatgctggctgctgttgcgatcgtttatcttgtgctcgtgattacattcggcggggccctcgcgccgtttaccattcttttctcactgccatttgccgtaattggtgcactggtcgccctgtacctggcgcatgaaacgatcagcgttaccgctatgatcggcgccctgatgctgattggcatcgtagtgacgaatgccatcgtgctgatcgaccgggtggtgcataaagaaaaggcggggctgtccacacgcgaagcattgcttgaagcaggcgcgacaaggctgcgcccgattttaatgaccgcttttgcaacaatctttgcactgatcccgcttgctctgggctacggcggcggcgggctcatttcgaaaggggtcggcatcacagtaatcggcggcttgaccagctccactttactgacacttatcatcgtcccggttgtttacgaatttttaatgaagttcaggaaaaaagaaaaacatccggaagaagtatgaaaaaagaggttgccggggggcaacctcttttttttgcatcaatggaagctgcaccggcgcttgcgttcggatccggcaaaacttgggaaagccgggatttatctgcaaaccccggttcctgttcgatttagcttctttcaagtagggctgaataagcaaaattctttgatttggtaagaatgctggaggccggttttttttcgtgcttctttaacgtagacgcgctctatgtgaaggaacgccttcttttttccatgcttccttaacgtagacgtgccctatgttaaggaagaccctcgtttttgcttgcttccttaacgtagacgcgctctatgtgaaggaaggtcttcttttttccacgcttccttaacgtagacgtgctctatgtgaaggaaggtcttcttttttccacgcttccttaacatagggcttgctgaatcaccaaacttcctagatttggaaaaacttaatacaatgtgcaagggttaaagatggattcttctatattttgaaaaagagcttgctgacaaattgggtacaaattcagaatcggattcgttcaccaagccccaagtaggacatttcgagcccggatgctgctccttttgtccttttggcagattcaaaaggacatttcgggctcggatgcaacgtgttttgtccttttgacggctacaaagggacatttcgagccaggattcagctccgtttgtccttttgacagcttcaaaaggacatttcagacccggatgcagctccttttgtccttttgacggcttcaaaaagacattttgggcccgggtggaggtcaatttgtccttttgacggcttcaaaaggacatttcgggctcggatgcaacgtgttttgtccttttgacggctacaaagggacatttcgagcccggatgctgctccttttgtccttttgatagcttcaaaaagacatttcagacccggatgctgctccttttgtccttttgatagcttcaaaaggacatttcgagcccggctgaagctccgtttgtccttttggcagtttcaaaaggacatttcgggtctggatgcaacgtgttttgtccttttgacagcttcaaaaagacattttgggcccgggtggaggtcaatttgtccttttgacggcttcaaaaggacatttcgagccaggattcagctccgtttgtccttttgacagcttcaaaaggacatttcagacccggatgcaacgtgttttgtccttttgacagcttcaaaaagacatttcggacccaaacgcgactccttttggtccttttacatcacgcaaaagaacaatttgacctcactgtacggctagtttctctttttttgccaggtccgctgattcgcatccttgctgaagaaattaaaaaagccgacctatctttcaggtccagcctcgtaaacgcaatgaagattcattttttagcaaacgctacaaaaacggccattgcaaaacccgaaagcccctaatttcccccaagaatgatcgcagcgggttcgggagcgggttttccaatatagtacccttgcgccaaatgcatgccgatcgatttgcaatagagcagttcttcttcgcgttcaattccttccgctagcacataaataccggtttctcccgcaatttccatgacttcctgcaaaaagcgctgtttgaccttattctcgtcgcaatgggaaatgaaaaaacggtcgattttcacatagttcggatttaaaattttcaaagtttcaagcgttgcgtaccctgaaccgagatcatcaagcgccacgccgacgccaagatcacggtagatcccgagtatcttttttaaaaagtggacatcattgatcttctcggtttccacaacctcaaagacaaggtcctccggggaaatatcgtactgttcgatcaaagtaaacgtatgccgcaagcaaaacttgtaatcataaatcgaagcgggcaaaaaattgataaagctcttcacgccgcggggaagtttctcagcacgggctttcagtgccgcttccctggcgcgcaaatccaataacgaatgcagtccggttttatgggcgacatcaaataataggcccgggggaatgttccggttcggcaaacgggtgcgcagcaaagattcatagccgtatatttggttgtcctgaatgcggatgatcggctgaaaataactcgtcaggctgccggaaataatcacttttacaagcatctcatagcggatgcgctcttttaattgagaaagcggcagggagagcaccgaaaatccggacccggacggatggacactggtgaacagatcaaccgtttcgggcatatcttttatgatatcaaataaagtatccttttcttcaaacggaaccattaaatgctcggaaaggacttcgtatacacaggatttctgcgtcatatattcaatgacagcctgtgttttttgtatgtataataaaccgctttccggaatataaaaagatgcatcgttctccaggtttggcttctcattcagcatatgattcatccttatccagtcgtttaacttatttataccaaaaaatgcccggcaaagccactattaaaagcaggcggcatcatcccggccggaaaaagcgtccaaaagcgctttttctccctttcctattccgcaattgagaattaaatatcgaaaatgaaaatagaaaatttctatctcacttctatttccaccccttttcttttgatataaaaaactttactttaaatttattataaataaatattgatttttataatgaatcagttataatatagacatcaaaatagcaaaaggtgggaaaatgatgagtgatcaaaaagacaacaaaaaaatgacaactgcattcggtgccccggttccgaatgacacagattcaaaaaccgccggcaaaagagggccgttattgatggaggatgtctggtttattgaaaagctggcccacttcgaccgagaagtgatcccggagcggcggatgcatgcaaaaggttccggcgcctacgggacattcacggtgacaaacgatataacgaaatatacgaaggcaaaacttttctcaaaagtcggcaaaaaaaccgatatgttcatccgtttctcaaccgttgccggcgaacgcggcgcggcggatgccgaacgcgatatccgcggaacggccatgaaattttacacagaagaaggcaattgggaccttgtcgggaacaacacgcctgtatttttcctcagagacccgaaacgtttcccggatttgaaccatgtcgtcaaacgcaacccgcgcaccaatatgcacagtgcacaggcaaactgggatttttggacgctgcttcctgaagcgctccaccaagtaacgattacgatgagcgaccgtggcattccggcaagctaccggaatatgcatatgttcggcagccatacgtacagcatgttcaacgcaaacaatgaacgcgtctgggtcaaattccactttaaaacacaacagggcatcaaaaacctgacggatgaagaagcacaggaaatcatcggccgcgaccgcgacagccatcagcgcgatttgtacgaagcgattgaaagcggcgactatccgcgctggacgatgtacatccaggtgatgacggaagaagaggcgaaaaaccttccgtataatccgttcgatttaacaaaggtatggtaccataaagattttccgttgattgaagtgggtatcgtggaactgaaccgcaacccggaaaactattttgcagaagtcgaacaggccgcgttcgccccgaccaatattgtgccgggcatcgggttctcgccggataaaatgctgcagggccgccttttctcttacggcgatgcgcagcgttaccggttaggcgtcaaccactggcaaattcctgtcaactatccgaaaaaagcggaacacttccatccgtaccaccgcgatggcgcaatgcgggttttcaatccggctgaaggcggttccgtttcatacagcccgaacagttacggcgaatgggaagacagcaaggagcacgcagaaccggcactcgatattttaggtacggctgactatcacaatttccgtgaagatgacgacaactattatgaacagcccggcaaactgttcaggctgatggcgccggaagaacagcaacgactgtttgcaaacaccgcccgcaatatgcagggaacgacaagagaagtccagctccgccatattacgaactgttattatgcagatccggcatacggcgagggcgtcgcgcgcgcactcggcattccgatgagcgaagtagaggcggctgtttcgaggaaataactggcggatgaaggtttgcggtgccgctaaatgcacatttataaaatgctcttcagtttttgcatcaagcccgcgcaccaatttgccggatgatgactttttgcggcaggcaaaagagcggcaatatttcgttcactttatatagatataaaacacaaaagacgttgaggcaccatttcgattcgtgccgcaacgtcttttaaattgatttagagtgacagggcacagtgctagatggtgtcccgccctcttttcgatagattttgccgggtcatttatatcctttttttgtaattttcgcccatatgtcatgataccagccgatcagcgtgctaaaagccgggtcaaacaaccctttcattttttggatggtccatactgttaacaaggcaacaataatgcttgccgcaatatcccccggataatggtgcccgacccatacacgggaaatgccggtcaaaacggcacagagcatcatcgctaatccgagtttccggttccgcacccataaggcgaaagccatggcaaacgtgcctgtcgcatggtcgctcggaaatgagtcgtcggccgcatgcggaattaaaatgctggtatgatacgtgacaaatggccgcggttcataataaacaagcgtaatcacataattgaccagcaaagcggcaacaccggcaatgccggcataaagcaccatgtttttcattttatcattgcctaaaaaccacacaatcaataaaacagcggcaaaaagcggcaaggcatcctgtgtaaaaaaaatcatgatgtcatccagtaatttttcatgccctgacaagttgtggaccataaaaaacaatctggcgttctcattcatggctctatttcctttcttctatggctggttttgatagaaaaatgtttgtcaaacatctcgtccatccgcacgaaccggaagccgcgcgcttttaatgccggaatcgcaacccgcaaaccttcaattgtatactgcggggcatcctcatctgcgcccggcgtgacgccgcaatcatgcagcaaaatcacatcgccgctttccacccgggtgatcaggccgtttgaaaccttttccgaaccgccttttctcttccaatcgcggaacattttcgaccagtgcaccatgcggaactgcttgtgcagaaaaaagtccagcagatgcatcattccccacggcgggcggtaaaaaaccggtctctcgccggtgatgttttcaataatccgtgccgactgctcaagcgtgcgcgcatttttccaagggctgatcagccagttgcactggtgcttataattatgaaggccgatacaatgcccttcacgcgacatgcgcaaaacgagttccggataccgggccgccctttccccgacgagaaagaaagtggccttaattctttcccgctttaaaagatcaagcagtaccggcgtatagaccgggtccggcccgtcatcaaaggtgagcgcaatctccgcatctttttttcctttccaacatacccaaaaaccgagtttggccgctaaaacatatggaataatagcatatatgagaatgaataaaatcaatacccagatgatgacttccaaaccgtgccgctcctttcatccaaagattcatgcgggtgatgcacaagcaaagccttttttcgcatccttgcatactttccgtgcgcggtatccggcatttccggatcagacgcatgaatgagccgtgcatatttcgcctggtcaataacggaaagcacccgaaaagcggcctctctgttttgaatcgatagcgtgtttcttttcatcttcgcaagctgtgccctgttttcattcaggcgggctaaacaccggattaacgtgccttcatctgctgcctcaactgctgcgcccgcttgtgttaaaaaggctgcgttatcttcttcctggcccggcagcgctttgtataaaatcatcggcagttccatggccaatgcttccgctgttgtcacgccgcccggtttcgtaatcatcacgtccgagacggccattaaatcacgcacataatcaatatagccgagcacgaaaaccttgtgcttcgtcccttgcagatcatccatcaggcgggcgcgtagtttttcattatgcccgcacacgatcaacagctgcatgcggaaaggtaccgcgtccagtttttcagccgtgaacagcccgtccccgaacaggccttccccgccgcccatgacaagcacggccggcaacgccggatcgaggccgtattttttgtacaaagcctgcttgttcaccggtttcaggaaactcggtttaatcgggatccctgtacaggaaattttccggccgggaatgccgagcctgatcaactgccggcgcaacatatgcgaaccaacgacatagtgatctgtgtacgggtgcagccatgaactgtggtgcgtatggtcggtaatgacggtaacgagcggaatatccgtaagcccgtattcctttaattttgaaatcatggaagacgcaaaaggataggtgctgacaataacggatggacgtatcgtttcgagcatccgcagcgtctttctcatccccgttgaaaataagccggtcaatgtttttgacagggcattccttccatacgttttacggtacaaatacccgtaaagattcgggaacttttcaatacctttcatataaacatagtggctgaccgggaataaggtgggatggacccattccatgaaatcgacgacaaccgggtctgcttttggggaacgaattttcatcgcctgttcaattgcccgggcggcctgcaaatgcccttccccaaaagcgcctgttaatatcaacactttgtcttttttcttgttggccattctcttttcccccctgcttttcggtctgtttacagaaaacgcgccgcttctctttctcatgcggcctctttcgatacaatacaatagactttgagggtaaaagaaaagttcatttataggcgataaaaatttgcggtcattgttttcctgctcttccatttaaacgaattatggaaaacactgtaaaaatttgcttcgaaaaaaagaaacaggcaaggcttttttcggaaacaaaaaccccgtttggaatttttttccaacaaggacaggcaaaaaaaaacgcaaccgggtactcacaaaaaaacatgcggctccttattttgcggccgcatgttttttcctgtttctccatttttgaaatagccatgtgaccgaaagcccgagcgagtaccagaacaaaatcaggaaaatgacttccccgacgagcgggatgctgcaaagggcaatcaggatcgtcacacccgttaacagtttcagccattcctgcctgccgtttaaaacggcaaaggtgctaccgatttcccggccaagaaacacgagtcctgccaggagggatacaaaaacagcaaggcataacagaaggacaaccggtattaataccactgtaatcgtcaaaaacaggctgagcgcaaggacgacaagcgacagcaggcagccggtaatgatcatccttccgggccgcgtgtagaaggaccgaatcccggaaaaaaacggttttttcgcgactaagccgaacaaaacagtgcacacaatcaacagtaggcttgcggaaagccggaaaaaccagagggcaagaagcatgacagcggcaaaaatcatactgtcaagcgttttattgttcatattgatagataagacatgttccgttacacgggcacccggctgctgtttgatatttccaccgagcacaaatacagagccgcggatatccgctgacttacgaatattcaaattcccattgatcacaatgacggctgttttgacatatccgctgacggtcgcgttattcccgatcacaacgacattttcgactttttcatttttcgggatgaccgtatgccggtcgtggatgatgattctcattcttttttcctttgcaaacgcagggtggaaacccgcccctgcgctcagaaaaagcaggagcaaggacaataagcaaatcaatatttttgcggctttcatctttttctccatcccctactccttcaccggcttcatggtgagaaggccaaacaaaatccagatacaaacggccaaaatcaccgctatcaccaccataatccccgcagacaaagccgggagcgcggaaagaatggaaagcgcaatatgaaagccgcttgaaagaatattgcagagggcctgaaaaatattcatgccgacataaaacggttttctcatcaccgggtaggcgcaaagcacagaagcggcacagcaaaccgcaaagaaccagacaaaaacgcggtaatgcatcgccattttttcctgcggcataattttagccagaaccgccttttcaaactggattcccggcacatcaaccgaatggtaaaaacggctgatttccgccttcaccgtctccagttcttccagttcacggcggcaatccgggcaaagggcaagatgggcttcaaccatttttcggtccgtttcacttaacgcatcatccatgaaggccggcaataaatcccggacgtgtgtttccatgtgatcaccctcttgaaagttcttttttcaaaatatttctcgctgtgttgatgcgcgacttgacggtaccaagcgggatgttcaagatgtctgcgatctcttcataggaatagccctggatatcgcgcaatacgatcgctgcccggtgttccggcgacaatttttccatcgcgctgcggatgtcaaatctcaaattggcgttgtcgatattggaagttggcctcctaagtggctcctcttctatttccgcctgaagatccactttttttcgcatttttttcagccggtcatagcataaatgagagacgatcttcgacatccaggaggcaaaagcataggcatgttccagtttatccagggcgtaccaggctttcacaaatgcttcctgggagatatcttccgcttccatccggtcgcctgtcatggcatatgcatgccggaacacctcccctttaaaccgggccaccagcacggcaaacgcatctgtatctcctgcttttgcctgccggatcaactgtgttaaatcctgctccaccattttcaactccctgcttaagcaacgcgatcttttgtcgttgcccgggcatgtgcaaaagcggccgggaaattgcaggtgcacttgcccatttcattccatgttcattatggcatattttcctttccgccatcaggaagtttttttcatccgcttagcgcctcatttggataggagtaccccataccggccggaaaacgggcggcaaaaagccgatgcaagcgttgggccggcctgaaacatgcgcccgaactccacggcaggaagatggtaaaagtacccggaaacaaaaacgacaagtcctttccagcaatacggccccatagacgccccgcaaaaaaatcaataagaggttgaaacatagtactggtccttcagcactttatccggcgtttggtttgctttgcggccgagcagaccgcggatcaatacatcaaattctttccccctgagttcgatttcgctcccgtattggcgcagccgccggtaaaaccgggccagttgcttcccgtcttccaaaatttccatcacctgttcctccaccggtttggtgaagtccagttcaaagacaagaccgtgttgtttcaaaaaagcaagattgatttcttcctgaccggggagaacggagtggataaaaatcggcagctttttttgaatcacttcgctgatcgtgacaccgcccggctttgtaatgatcgcatccgcttcatcgtacagccggctcatttcctttctggactggatatagggaaccgggatgatatgtttcatcccccatccattcagcttgttatacagtttttcgttttttccgcataacacataataatcggccctgcccggctgttcccgtttcaatgctttcagaaggcggtacagatcgccgaggccgctgctgccaccggatattaagattttttttcgtgacgtatggcgcaaaaccgttctttctttaaacgcttcatgaatcggaatgccggtgacaaaaatgttttgttcgggaacgccgttacagatgagcgtcgttttgatcgtttggttcggcacaaaatggatgtcaatttctttctttccccacaagccgttgacgaaaaaatcagtgtatgcattgataaccgggacatcaatttttccttttgacttcagccggctgagcagcatcgacggaaaactgtgcgtgcaaatgacaagatccggattttcctcggcaatcagtttttccatttgcttaataaaagagagttcatagaatttcattaatgcggtctggtcggcatccgcataaataaaatgtttgtacacccattggtatgtccgcggtgctttctggatccatttcaaatacattttcgtgacgattttctccagcgtcccgctcgtataggaaatcacatcaacttttttcatttcaatggtactgtccatacatttcaatttatgcattaacgcctctgcgacctgatgatggccggacggcatttttaaaagcggtaaaatgagcactttagccaagctgtcttcctccttttccggaagcctgttctttttacaataaatagacttccgcaattgccgggaagttcattctgttttttaccaaaaaagcagattttaaacaattgaattgtataccggatggatgtcttacaacaagtattttgccaatattggccgtattttgagcagcagccgcctgcacggcttttaagggcgttttggaccaacatttcacctccttaaaacgaccatgcaaaaggatggaaatcaaccgacaattttttctaaatatatcgcagttctgttgcctgctgtaaaaaacagtcgtcgtgcaatttggtgctcaggcttgatgtaaaaacttatatagaaccgtgctgcgcggtatttcgctcggaaaacctttcacgtaaatcaccggcaggcttgtcgccagtttcccgcgtgccgcattggttgctgaaaaactgcgggttttttcattgaattctcacggtttattcagaataagccgctatactggtcccttgagaaacctggaaaattatgcaagaatacgaagtgcaggcggcggggcatgataaaaaagactgttttcatgcaccactaacctattacacgccagagaatggattctatgcgtaaagaacattacatgaggtgagtcctccatgttcgtgaagaagataaccattagtcttttcagtatcatatttacggtgtcatgcgctcttatcacaatcggcagtttctttatcgcaccgctgtgggccaaaaaagatgacccgcatttcgtgctgcttgatggaaaatggaatatttcaacggggcagatggcagcgctgttcctcttttccgtagtggccatcctgttttatcttggctgtttccgcatttttgcaaggctttcagacaaagggctgaaaagaatggcagcctttttgtttgccgttattttgtctattgaaacggcgattcttatcctgtttcacggggtgcagccgcccaaggtggatggtggccatatttatctggaagctttgtatttattaaagcacgggaaattgctcggaaatgagtactatttgcagctgtacccgaacaatgtaccgattaccattgcccgttacctgctttaccgctacctagcgtttggaaatccagactggtttttgattgtagataagctggcagcggctttattcctgaatatcgggatcttttttctctggctgctggcggtgaaaacatccggccgcaaaacgggaaatttgctgcttgttttcaccatcacatggctgccgctctttctttatatcccgtatttttatacagaaagccttgcgatcgcctttccgtccatggcggtgtatttttggtatggccacagtcggacggggcgcccggtatacctttttctgcttggtgcagtgcttgcagttggatgccaattaagggaaaatatggtattacttttgcctgcccttttgatctacatgctctacacgctccggctgaaacaaaccgtgctgcgaatagcgttcattatgcttgtttttttgcctgtcacttttggggcagaggcgtattaccaccatctcggctaccgggaaaacgcaaccatcaaggcgccggtaacccactggctggcgcttggcctttcaaatgaaggccgatacaatgtcgcggatacgagattgtcagaaagtcttcccacccaacaggcaaaaaaacaggcggattatgcactgatcaaacagcggatcgaaacgaggggtacatccggtctactcaagctttgggcggtaaaagccttccgcacattttcacaaggcgatcaggcctacgccaagtacaatcagcggatggaccattacaacgccgcataccgctatgtttacggagaccagaataaagtgctgttgtttatcatccaggtatttcatatcgcaacgctctttctgctggccgtttcgggcttaacgttcttccgtaaaataagatttgatgttcaattactcatgcaaatttgcttatttggcagctacttgtttttcgtttttatttgggaagcagaaccgcgctactccctcctgttcacgccattgatgattttttgcgctgcacggggtcttgaaaagatgcatcagttcttggaagcaaaaaaatggctgccggcacaaaaaagatggaaactgcaaacagcaggaaactggctgctcgttttaagccttattgtcctgctcgccgtttgcgccaaatggaatgaaaaagcattcacagggacaaccgaaaaatacgaggattatatcgtcaaccagcaggcggccagaggaaaacctgttgcgcttgttgaccggcatcataccgttacccaaacgtttatcgcagacaaagctttcgaccgagtcgcttttatgcctgcccgattccacggtaaagccgcataccgcgtttctttatggcataaaagcggcgggcggcaaaaaatggtgtttgaacgaaaatttacaaaccataagcgaaaaacaaacggctataaggcatttcttttgaaaaaagccttgcccggtgaaaacaggcattatgcactccgggtcgaacaactctacggaccggcgcatgcccggatgttccttcatgcgaacggcccaagcggacattttgagcagatggatttgtacggagggggccaattttaccaaaacggcaaaccgatggcaaaaacagaccttacgtttaccgtatcaaaacagattaccggtccccatataaaccggcacctgtacagatggctgtttggatgtgctttctttatgcttttactctatgggcttactgtcctgccgggaggggcaagcagaaaagcagctaaaaaaatccgcgaatttgtggatgcctgatcaaaatctccccgcctgagccgtttggcagcccggcgcttgaccaatagaaaagttggcagatgcgaaagacctgagccggcaacaaacgggaagcttgtggaggcctgaaccagcgggcggggaaaatttctgcgatcataccgcgcgctggcccggatgttccaatgctgatggaagccaaatcaaaacggcgagagcagtttctcgccgtttttttttgagaacatcttttaaaaatcaggatcatagctgatatcaaggtcaaaatggccggtgatgccatcgatcgttccggtttcggtgtactgccaaacgtctgcattcgtaccgagcgtgatgttataccgtgccagccagattttggtattgctaggccaagaatctgtatggccctcaagatagcttttccaattaaagtagccggcataaatgcccactttcgtctgcccgagcgtctgcatttcatttaagaaatagccagcacaagccggggccgcatttgcccaccaagttgttgtaatgctattcgtcccggtaggttctatatcttcgaaagcgtagcccgtaaacgcatagccggttttcgcctttgtttgggccagcacttgataaaaatgcttggcttctgcaatatgctgtgcggaagtggtggtggaattgccgatcatatgataagcatggaccgacaagccggcgtttctggcatacttataataggtataaaacttcgaatccgtatatccgcttccttctgttgctttcagaatgacaaaattgtagccctggctcttcataaggttaaaactgtcttgtgtcagagtttgataatggctgacatccagtccctttgtcgtcgtggcggatgcagtggctgatccggtactgcccgttgtggtcgttccggatgcagaacctgatccggtgttgcccgttgcggtcgttccggatgcagaacctgatccagtgttgcccgttgcggtcgttccggatgcagaacctgatccggtgttgcctgttgcagctgtcccggatgcagaacctgatccagtgttgcccgttgtggtcgtgccacttgttgctgcggcagaccctgtagatccggacgtgctgccggttgccgttcccgtcgttttcccacccgctgtggaagaccccgtttggcttgttcccgtcgttgtgcttgttgttccacccgctgccggtgcaggttttgtgaagtggctcgtataaatccagccactttgggttgtcccaacgacgcagatatgggacatattttgggtgctttctttcacatacacctgctgattcggtctaataacagccgtatattttgtatgggatgcagatgtatacagtttggaagaagcatagaccgtttttttcgcgagcaagccggttaagttgttcgcataaatatatccggagctattgcctgctttcacttggtaacgaccgtgcgacccattaaaaaccgacaccttttgcccatctttaatcgtcttgttatacgaatttccggttgcggatgtgtataatttagacggcatccacgtatattttacaaccggtttaataaaatgggttttgtcaacatagccgctgtacccggttccgatcacgtgggccagatacatgccgtttttcgttgcttccattttgatatacatcatcttccccgccggtacggaagcaacatacgggccgcctgccgcctgcttataaattttcgaaccaaaatagtcctcttttttcactttgctccttgtcaggttatcagcataaatgtaacctgttttcccacctgctttcaccttatagcgcttgcctgacttgctgtagacggttaccgctgtcccgctgttcacatttctggagtaagccgcgccggacgccgttttataaagcttcgacggtgtccacgtatacatggtagacgaggcggctgaagcaggcttcacaaaacttagcgcaaacagcaataaaaaacccgcaccccccaaaaaaatcaatcttcgcaatctgtctcctccttttgttctatgtatcaaacaccattataatcaataaatctcgtaaattttatcccgaatttgaaaaaaaatagtgaacaatcattctaaatgagtctatatacctatacagggttacattttgcctatttgaaaggggatcgatcaaaaaaattgcaaaaaccactccaaaacggggaattgcctggattgagagaagaaatttatccgcagcaactgagatttaaaccatttagactgaaatatttccgcgagatcacgagagaatgataaaaagaatggtttggggggcgccacagtttttaccattccatagctaaaaagcattcctttcctttggctgcaagttgttcagcaccaaaaaaaaagaatgcttttttaaatcattccctatgaaaaagcaagtacgccaagcatgaatgggtgatgtttaagtgtaaaacttgagtaaagtatctacgaatgatacaaagtgaactgctggccttctgtttcgaacggattttcttctatttcaaatccgagatcttcaattaactggtaatcttcttttgcgtcctggccctctgtcgttaaataatcaccaataaaaatggagttggcaataaatagccctaaattctgcaaagagcgcaaatgatattcccgcccgccagcaatccgaatttcctttgtggggttgacaaaccggaacaaggacaaaatttttaaacaacgaatcggtgtcaattcgtccatattttcaagctttgttcccttaacaggatgcagaaagttgaccggaatagaatcagcgtccagatccttgagcgcgaatgccatatcaattatgtcctgatccgtttcccccatgccacaaatcacaccggaacacggggagatgcctgccttttttacgttttcgattgtgttgactctgtcttcataaccatgtgtggttgtgatattcgcatggtggtttgcacttgtattaatattgtgattaaaccggtccacacccgctgccttcagcttgaacgcctgctcttcagtaacgagccctaaacaggcacaaatttttaattgttccacatcccgcttaatttcctcaaccgccgcaattactgtgtccacttcacggttggttggtcttcgtccactcatcacaatgcaatatgtaccaattttattctttttcgcttcctttgccccttccacaatcgtttgtttgctgactaatggataccggtcgatttttgttgccgccttaattgactgtgcacagtagccgcaatcttccggacaaagaccgcttttggcgttaataatcaaattcagctttaccttttttccataaaaatgccggcggatctgataggctccatggacaagtgctaatacttcatgatcacgaaccgttaaaatttccctggcctcttcttcccttatcacataaccttcaatcaccttttctgccaaattcgtccaatccacgaaagtcacccctttttatttgtcaacctaaattaatttatggtttacatttaaaattatatgacagttaaaattttggtcaagtattttttgcatttttcacacaaaaaggtttggaaagggatgcggcatttcacttgtccgccccaaaccactttggcatgtaaaacgatcatgccgcagagatacatcccaaaacaaaaagcccggcacaccaggaaaaacaagtgtgccgggcttttttcgccattatcgtgtattttattgcggctccggaaaaagcggaaatgccggattttttacctcgccgataccagggagaccgatttcataaatgcgtccaatgctgcccgcgtcggcaggccgtcattgtccccgaggctttgcatctggatggagcaaatcgcattgccctgcattaaaagcgcctgatcgtcaagctgctccagcatgccggccagtataccggatacaaaaccatcacctgctccaatgcggtcaaccaaatgtttcacttcatattttggcactgccgcttcagcaaatgaaccatcttccaattttttctttgaatacgaacctttttccactaaattgatgatcacctgccgcacacctctggataagtaaaaatccgccatcttttctttttcatgctcgccggttaaaatctgtgcttcttttgcatttggcatgacgacatcacaaaggcaagcgatttcatttgtccgttccatcatcttttcttccgattcccaaattaccggacgcaaattcggatcaaacgtaatcgtaaggccgtatttccgggctttttcaatcagtgccaaagttgtctcgtaaccactttcgcttaatcccgccaaaatgccgccaagatggaggatctttgcttctgaaaaatcaacctggcgaacggcttcttttgttagtttagaagcagcactgttcttcctgaaataaacggtttccggatcgccaatctccgacagcccttttaacatgaaacccgttggatatgttggtgttgaaaaaacataggtggtatcaatgttctcattgtttaagaaatttttcacatatacgccgaaagggtcttccccaatctgcgtcaaaaacgaaaccgtgtgcccgagcctggaaaccccgacagatacattcacatccgcaccggccatataacgggtataatgccggacagcatggagcggccccttttcatccgcaataaacaacacaagcggctcaccggcagtgatgatctcgctcatttgattcgcctccatataatttctaaataagaaattaagtttactatttgtattacaatttcattatagaggattatggcgattggtcaagaaattccggtattgtttttgtaaaaaaagaaagctcctctttggagaagagaagcttattgctatacattctatttcaactcttccattgggacaaaatccatatcatcataggtgatattttccccgcacattgcccagatgaacgtgtaattgctcgtcgctaccccgcaatggatcgaccaactcggggaaatcaccgcctgttctgaagataggataaggtgcttggtttcatccggtttgcccataaaatggaatacccgtgtatccggttccatgtcaaagtacaaatacgtttccatacgccgttcatgcgtatggcttggcatggtgttcatattttatgagattgctaaattactatgcttaataataaacaaactatcaatccaacaacagagtttactaattctaataatccccatgttttaaaagtgtctttcatagaaatacctagtgtttgttggaataatagaaatcctccatcatacattaaagttattgtgttacttccacaagctattgccagcaacataagtactgggctaacattaaaactgcttaacataggctgcattataccagcaacagtaatcgccgaaacggctccttgtccagtcataagtcggataacaacagtgagtatccaagctaaaattagaggtgataaactactatgctccattacttttactatgttgttccctaccccactatcaataatgatttgtttaaatgcacctccggcggcaattactaaaatgacatttgcaacttctgaaatagcttttgacatatgtgtttgaatagtttgtccatccattcctctttttatcccaaaaaagtacatacccactaataaagcaatcgtcatactaacttcagcactaccaaaaaataaaactaatttatataacattgaattttcatttgtgaaaaatttaacaattgaagatattaccataataattgctggaataagaggtaccaataaactagtcccaaatttaggcatctcttcttcagtaaattttttaggagccttgagaatatcagccaaaggaagtttatctaaattccttaaaaattttggtagaataattcctgcacatataacagatgggatgataacaattgctccaattatataaacttgacccacatctacattaaatgctgatacaagtgccataggaccaggttgtggaggaaaaaggctatgccccatagttgctcccgtaacagttggaataatcaacttcatatatggtattttagcttcttttgcaatactaataacaagtggtgctgcaatgagaaatgctacttcatagaacatggccataccaaaaataataccaattaaaactaaagcccattgcaaatattttatcccaaatttatcgattattgttgtcgctatcctttgagaagcacctgattctgtcatcaattttccaataatcgctccaagtgcgacaattaaagccagcgaacccattgtgctcccgacaccagattcaattgtcgttgcaattttaccaatatccattctttccattagtcctacaaataatgcaaccaatagaagtgctaagatattatgcatcttatacttcaaattaaaaagcaaaagtaataaaattcctaaagccacccataaaaacgaaaaaaacacgtccattattttttcctccttcaataaagaacaattatctctacttgaacccttatctaatcatctgctcacaaaactgatgattagataattataattgagtatttttacttcattaagatacctgcttttctaacgcttcccacaatccatttagatatgcaatccctagtgctctatcatataagccataaccaggacggccaacttcaccccagatcattctgccgtgatcgggtctcatatatccgtcaaagccgacatcatggaatgctttcataatttcgtacatatccaaagatcctagttcagataaatgagcggattcgtggaaattcacatcacttgtaaatttaatattccggcaatgtgcaaaggcgattctgtctctttccccaaaatatctaatcaattgcggcacattattttccggattttcccctaatgatccggtacataatgtcagacaattgcttgggctgtctaccatttccacgattctctttaaatcatcaaagttttttacaattcttggcaatccaaagataccctttggtggatcatctgggtggatagccattttaatgtcatattcttcacatgttggtataattgcttccaagaaatatttcagattcgcagttaatttattttcgtctacatccttgtatttttcgaataacctctttatttcctttagccgttccggttcccagcctggcataacaaaaccatttgaattgcttgtcaaagactctaccatattggttgggtcgattttatcaacaatagcttgatcataggacaaaacgattgatccatcttcaagttcaaatgccaaatctgttctggtccaatcaaaaataggcataaaattgtaacaaattactttaataccatattttgataattttttgattgtttgaatataattttcgatgtattgatctcttgatggcaatccaattttaatatcatcatggatattaacgctttcaataacttccaaagttaaacccgctttttccacaacgtctttcatatgtttgattttgtcttcaggccatacttccccgacaggcacatcatacagcgcaccaactaccccctttacattcggaatctgcttgatttgttgaagtgtaatcttatcatctttctcaccaaaccatctgaatatcatttgcatgtcaaatctactcctctcatgtcaagtatttctttaatgttgctcggactgcacctgtgccagcaattaattctcttacatagccctcaattttttttccaagtccaacactgtataaattcacaccaaaaatagattggtttgaaagcaaaggttgtaaatgatctttaaccgaattcggatcacccaattttaataaggaaatatatccctgaagttcttcaatcaaaggatccggacttaatttcatggtatttccctcatcgttcagtcccattaagtatctgcaccatccggctattaccagtggaatataacataagttttttgcttgatctttataaagttttatcgtttcaccaaatctaatcgcaagtttttgtgatgtatcggaaataattctttgtggcgtatctggaatatttttatttggaagcctcttttccatcacttcatcaatgaactttttaggttcaataatcacgggattgattactactggcaaaccttcctgatacccaactttttctataagctttttaatttccggatctttcatctcttctgcaatcgatgtatatcctaataaacaaccataaatcgccattgacgtatgaagcggattcaagcaagtacaaactttcattctttcaactttatcaactgtttctctatcagtgaggtaaacaccagctttttcaaatggaggccgcccattcggaaaatcatcttctatgaccaggtaatgtgtttcctcagtattgacaaacggtgctgaaaccgatccttttttagtttgaatgatttccattgattctaagcctagtttttttaataaatcttcaaccacttgagatgggcttggtgtaatgcgatctatcatactccatggatatgatactttgtctccatttaatagataattaataaatccatgatcaacaaagcctttttctttccagtgctttgcaatttcatatatagaggatttcagcttatcaccattatgggaaaaattatcggtactcaacaaagcaatcggaaatgaaccgcatttatacctttctaataacatagatgctaagatggacattccatgtttgacatgttctggcccattttcaatatcttccttcacaattggcaagtaatcacccgaagagctttttaaattataacctttttcagtaattgtaaaagatacaatttgcaaggaaggtgacttaaatatctcttttattctgtcaacagatgcagaagattgatctgaataaaaatagctttccacaacactcccaattacttctttatctattgaaccatcagcttttgttacacacattaatgtcaaattatcatggtcatgatagactttttctaccacttcatcatcaaaaatatttaccacaataattccggtattggctagatcattttcaattaggtgttgttgaattttcgcatggaaacatctaaagatatttcctccaccaaaatgaatccaggttggtgtatttttcgtattcttttttactttttctagatcaaattttggcagcctaatacctcgaattgtaaattcttcttttttttcttctatttctttttgaagcagaaaaagcattttttaaaattcccccattttctttttttaaagataaaaaatgtttattattaagaaaattagttttcctacttacctatatctttaatttactttttattttttaataataaggtacataatttcattagaaaaaaattaatttcatttatattcttacttctgcaactttagaatgtacatagttctggacaatacttagggcttgcttaacaaacagaaattacgaatttgacaattggcacttttctaaaatataaagtggaaacacgtaaaaacttgcacttgatgaccataaatatgtactaaaaaccggactacgaataacctttatagaagaaatttcttactttccttctatttgatagaaaattaaataaagaacattatttcgcccgtcttgcagaaaggttcctttgatagaaggtagaagtaaagtatgccaagttcttcaagaaaaaatataaggacaaacggcttgctctgtcagaatcacccttggagctctttatattaaaataattcttggctatctaacagggagctttcgaacagattagtatcttcagtctcttactagtttgcttgaatctcaagaaaaaaatccatttgaacattctctgatgaacttaataacaaaatgcattttttatagtctaatttgtattaccaattttttgatacatttatccccttattcctcctctttttttataatttatttactctgttacgccgttcttaaatattgcaatctcatgcatatggcgaatgtcactttttgtcttcttcccgctcgcgacttcaagaataaaagaaataaattgttctactacttcgtccatttcttcatcaagcagccgtcccgcgttgaaatcaatccactgctttttcttttcataaagttcggtgttcgtcgatactttcacagttggcacaaaggttccaaacggtgtgcccctgccggttgtgaacaggaccatctggcaatccgccgctgcaagcgctgttgaggaaacaagatcatttccgggtgcctgaagtagggataaccctttttcctttagtttttctccgtattccagcacatcgaccactgccgatgtccccgctttttgcgtgcagccgagcgatttgtcttccaaagtggtgatcccgccggccttattgcccggagaaggattttcatagattggctgcccgtaagaagcaaaataatctttaaattgattaatgagcttcacaattttattgaatacgatttcatcttttgctcgtgccattaacattttttcggcaccgaacatttccgggacttccgttaaaacagtggagccgccttgagaaatgacaaaatctgaaaatcttccaagcagtggattgccggtaatgcccgaaaatccgtctgagccgccgcattttaatccaattttcaattctgatagaggcagatcgatccgcttgtcctcttttgcagcttcattcaattcttccagtagttggaagcctgtttccacttcatcttcaacatcctggcaaatcataaactttacgcgcttttcatcaaactctcccatttgtgccttcatttcatctagctggttgttttcacagccaagcccgaagatgagcacaccgccggcatttggatgggcggccgcatccattaaaatcttgcgggtgttctgcaaatcatcccccagctgggaacagccgtatggatgtttaaacaatataatttcatcaaatgcgccgttatcagggtgattcgccttaaattggtcaacgaggagatcaccgatcatattgatgcacccgacagtcgggatgatgtataaatcattgcgtatcccggcttttccgtttttccgcaaataacctttaaaagtgcggctgtctttcggaaaggtgcggggatgcagttccggcttgtactcgtattccacttttccggaaagattggtgctcacgttatgggtatggacccagctgccttgttcaatcttttttgtcgcatgtccaatgggtgacccgtattttataatgtccgcgttctcctcgatatcttctaaagcaattttgtgtcctctttttattgcctcgtttacggtgatcgccctatccccggatgtaaggacatcacccggctctaaatcctgaagagcaacgagtacattatcccgggggtttagctgaatggttttatttttcaaccggtaatgcctcctcgttggcctgctgcactgccctgcgaacgccctctttttctatcaactgtaagcctttttcaacttgagcgggcaggccgtcaatttttgtcagatccattccccataaggtttcgttgcttaaaatgtcccagacatagcggtcggagtgatacgccattgaaaactctttcaaaacatctggcaaatcaatcgctttagcagaggcatgatcctgctctccgtaaattttcaacagcccggataaggctaacgtaattcttgacgggattttgtggaatctttttacatgctccgccaatatgggcaggaggcgtgccttaaattttgaaacgctgtttaaagcaatcgcgtccagctggtgttccatatacgggtttctgaaacgttcctgaatttccgccgcgtaacttgtcaactcttcttttggcaaatccagtgacgggatgatttccgcaaacatttcgcggtcaatcaaccggtaaaaatcgggatcttccattaccccgccgactgttttaatgccggcaagccgcgccaggcaagccattgttgtatgggggccgtttagtaagtatactttccggtcgcggtacggttttaaatgatcggtgaccacgacattcagccccgcttttttgagcggcagttcttcttccagctccttgggcccttcaatcacccaaatgagaaatggttctgcttttgcaattaacgtatcttcatagccccattcttcccaaagtttttctgcgcggtctttcgggtagcccgggacaatccggtcgaccaggctggagcagaaagtattttctgattcaagccagctgctgaaatcttcgccaagcttccactcatccgcatagcggtgcacaatttctttcagtgccttgccgttattttcaatgagctcgcaaggaatgatgtaaaaccccttttttccggccttatatctttcatagagcagtgccgtaagttttgccgggaaactgacaggaggccggtcggttaatgcatctccttcacgatagacgatgccggcttccgtcgtattggaaaaaataaaccggatgttgtcatcatgggccagttgtaaatagacgtcataatcttcataaggattgatcccgttatttacagatgaaataatctcatgggactggactgcttttccattttgcattccttccagcatgactgtgaataaaaagtcctgtccagcaagttgccctactctaccgcgtggcaatgattgtacaattgtcaccccaccttgaaaaagtccgcgtttgttcatttgctcaatctgccagtcgacaaaagcccgaagaaaatttccttctccaaactggatggctttggttggataccgttgcaggtctttcacgtacgagtaggataattttttcaaattcgcccctcctttatttcctatttggaaatcaagtttcttatttgttcttacactccttattataatccgctttcaaatttattcaatagtttttttggtttttttgagcacttgtttaccgaacgacttcccggccggaagcgccttcccatgatcggacttcgtctgctgaaagcggcagcgcatccccgttcacagaatgtttcaacacagaggtggcagtcgcaaattgtacggtttcttccggatccatcccggttaagaagccgtggagcatccccgccgcataggcatccccgccgccgatccggtctacgatctgctccatacggtaacgcctggattgtataaaaacaccgccagtccagagcatgccctgcaattcatggcaggtcggggagatgacgttccggtctgtcgcatagagtgcgcggagattcgggtacttgcggctgatttcccggtaacatgcttccatattgccgggcacagccaccgatgcatcaatgccaaaaaagtttcgggcatcaagatagttggcacagcagtaagtgagcatcggcaagatcgggataatggctgccctcgcctcttccatcgtccacattgccggccggtaattgatgtcgtagctgaccggaatgccgcgatcaaaagccgctttaacgagaatttgcccataatatttccatgattcggacacagcaaaggtaatgccggttaggtggaaaagggccacatcagcaaaaaggcggtcaaaatcccactcgccaatatccatctgtgaaaagctggaactttccctgtcatagatcactttggaattgcgcaatgtgcccccctgttccaaaaaatagatgccgagccggttgccgcccattagaagacgggaagtatcaataccgcttgcccgaaggcttcttactgcagccgctcccaaaggggaatccggtactttgctcgcaaacgcaacgtcatgcccgaaactggcaagcgttgtggcaacattcgcctccgccccgccgtaatttacattgaaagaatggctgcaggataaaagatctcccggggaggtggaaaggcgcagcaaaatctctccaagtgttaaaattttaggcatattgacccctcgattgctgatgcacggcttctgttagttgctgatatttgtccacaaacgctcttgctgtctcggtcactttcgcaaaatcattggtttcggcaggtttcaataagcttccgcctacgccaaggattttacagcctgctttgatccaatttcccatattgtccagactgattccgcctgaaggcatgatttcaagttgcggcagcggagcttttacgtcttttacaaatgccggcccgacaatattgcttgggaacagtttaattacttccgcccccgcctgcatggccgctttcatttcattcaccgtcatacagcccgggatataagggatttgataaaggttacaaaaagcagccgtttccggatcaaatgtcggcgcgacgatgaattttgccccggccatttgcgcggtctgggcggtctgggcatccagtacagtgccggctccaacgaggacatcatcacggtcttggtacagttccgtcaattttttgatggcaacatccgcattcggaacggtaaaagtcaattcgatgcttttgatcccgccggcaatcagtgcatccgtaatacgcaaagctttttcaacggagtctgcacgcagcacggccacaattccatttttttctaacgcctgcaaagtctgcatttttttcatggtggacgctccttttaatttctatataataaactttatttatgaataataaattcaatttcattttacaacacactctctcctatgtaaaccatttcatgaaagagaaaataaaaaaaacttgccccgtgtcggaacaagttttttccattagccattcaatttgctttcaattttttgtcgtgcctctaagatgcttgtaatcattttttgcttcttttcttctgtgatccggaaccgcggggcactaacgctcatcatgccttcgatctttccgttccgcttgataaccaccgcaatacagtaaatatctttttcattttcttggttgtcaattgcatacccacgctgtttgacttcctggagatcttgaatcagtttttccgggtccgtaatcgtgttttcagtccttttttcaatcgtaatccgggacaaataatcacgcacatctttctcgctctgttcagccaagtacgcttttcccatcgcagaacaatacagcggcagcgtatgcccgacctgcgagcttaaaatgatttgcccttttccgttcagctttttcacgtacaccacatgatcctgttcataaataccaaggtggacggtttcgccaatggtgtcattcagttcttcgagcaccgcttccgccacgtttacaatattaaaagatttgcgggcggtttccccgtaacggataagcgcggtaccgagcgtatatttctttgtctcttcatcccgtttcacaaaatcaatcgagcaaagggtatttaaaatttttaagaccgtggatttgctcgtatttaaagccgtgcaaatttcctgcaggctcaccgggtccacccggtattccagatagtccagtatatctttcgcacggatcagcaccgtgccgtacggttttttttccgttgtcgtctccatctttttatgctcccgtctttttgaagtagccaaataagaaactttgaataccctctttataacataatttaaaaaggttgtaaaacgggacgtgatggatttccagaagagaaaatgatggataagaatcgtgaagttgtccgaagtattggacaaacgtatgatgcgcatcatatcattgagaataactttgatggccctcatgcgtggtggaatatggaatattcatcttgcaaaatatccgaatgaaaccaagcggcatacatggaaagggagcgacgtcagaaaaactgttttcaaggaggtaaaagatcaaattggctaattttgaatttatgaataggtacaagcataaaatttataatgtaacggaaaatgatattttaatcgctgagcagagaatgaacataagttttccggtcaagtctttttttgtgtgtaaattcctctcagtcgggatagagtaattaacccgaataaatgtctgtcgctttgttggattggtcagacgatttcggttgtttggctttccattcaaaatagtcttccatcttcaaatagcggcgtccttctgcccatttttcatccttttccatgagaacagaacccattagccggattacggaatcccggttaggaaaaatacggataacctgttcccgacggcgaaattcttcattgagtcgttccatgccgtttgtcgttctcaggcgacgacgatacggctccggaagtgagagtgctgcagtgacatcgtcaaaggcttcctctaccatttcagtcactttaggcgctttatcctgataagtattcagaaaggactgaagtagtgtgtgtgctgtttcaatgtctggagcgtggagaatggctttcacttgttcagttccttcgctctctaaatgttttggaagccgatcgtgtacgttacgcagaaaatgagcttgacatctttgccacgttgctccctgaaacgctttttgaacagcgctgactaaaccgccatgatcatcgctaacgattacatctacgccctttagtccacgagattttagccaatcaaaataattcttccaagcctctgtgctttcactgtcatcgacttttaggccaagaatcgatcgatagcctttctcgttgacaccatagctaatcaatacaccccgggaacggacacggccattttcacgcacctttgtataaattgcatccacaaacagaaacggatagctgccctctaggggacggttattccagcccgtaaccacgggatccagctgcccacaaagattcgacacggtcgacttcgagaagtctgaaccacagagctcttcggtgatttgactgacacggcgcgtagaaacaccattaatcaccatttccatcaaagacaggaccagtgcttgttcactacgctgataacgctgaaagagatcagttgaaaaatgaccgttgcgcagcctgggaacgtacaaagagagctttcccacgcgggtttttagttggcgggggtaggagccgtttcggtaatcaattctagcttcattacgttcatatttttcggctttcagctgttcgctggcctgtgcctccagaacttgattcaaaatcgcctccaaaagggcatttatacccgattcttttgaatcgccaagaaataattgatgcaaaagttgttcatctagagtaatctgtaattgagccatccctgaatctctcctttagaaatttagttttttggttaactctattctaactgagatgatgggctctggctcattttctataaaaaaatgatagagacggcaagagaaatgaaatcccgctgtttttctggagggggctggccagccccctccagaaaaacagcccctatactccatattccctcatattcagataaccctttttacacaattatacggacttaacttgcaagatattgaattactgctagacgatgatcttctgaatgattaaaagcactaacagtaatctaattataatgtatgaattgaggaattgaaaacaaaagcatgtctgtagttgcatgacttcgccgttcaattgtcagcacatccccgtcttggatttcatcttttgtcaccatccaagccctagtgcccctgtcctttcaaagtttttacctgatccccgttggaaagtgtgttattgccagtcacgaaccgagccgttattgtaattaggataacctgcaatatattcaaaagctttttcttcaggagttcttcttcccttcttgcctattacaactgcaatttcaacttcataatcgagctttatttgattagccggcctctcacaccacttatccagacttctggataaccccgccgtgcgtacggttcggtacacggagtctaaagtttacgatggtacagacagataataatccagaaattctctgctttttcatcaacgcagtgtcctttagatctttctataagacacttctctgtttttttcttcacccatttgttctttaagtaagcatggtgttaaccataatatattgataaaatacgcttcaattccttgccggcagattttaaaagttcaatagctgtaagcattaggattcggtatagatttttacagattcgttgaatgggaaaaaagcgctatcatcaggctaatagactagttacattttactatttttttattttttatgtaaattcaccatatttcgtcaataattttatatttcgcatgctaagattgattttactattgatgttgaaacaagaaaaaaaccgccgcaacaggatacgtggtattccccgcaatctatgattcttccatccttcaacaaaaatagcaggttcaagcaaggaggtgaggatttttttcttttttgctgccattcttacaaaatcaggagggatcaagttgaaaaaactggtaaaaaaactggaaatttgctttattgccgcatcgattacgctatttgcgggaacagctgccacagccacgactgccagtgcaaaaacaatagcagcagccgatagggtaaaaggctgggttgcacatcatccgcttcattacaaacacaactcaaacgggattcatccaaatgctgtctcaactgtttactcaccagcacaaatcaaaaaggcttacggcattgatcaattaagcaagacaggtgccggccagaccatcgcgctgatcgaagcgtatggcagcccgaccattaccagcgacctcaacacgttcgaccagcagttcggacttccaagcgccaacattgaagtcgcttatccaggcggcaaacctaaaaaagacgagggttgggcgctcgaaacagcccttgatgttgaatgggcacacgcgcttgccccgagtgcaaaaattatggtagttgctgctaaatccgcttcaatcactaatttactggcagcagaagattacgcaacaagtcatggagcaaccgttgtctctaacagctggggagggtcagaattttcaaccgaatcttcctataacagtcattttaatcataccggcattacttacctcgcttcttccggagataacgggagcggcagttcgtggcctgcatcctcaccgaatgttgttgcggtgggcggcacaactttaaatttgaccagcgctggccagtacggtagtgaatctgcatggtcaggttctggaggggctaccagcacttacgaaagccggccttcctatcaatccggttggacaagtatcgtcggcgcaaaacgcggtatcccggatgtatcttttgatgcggatccgaacacaggtgtctatgtctactccagcacaaaagacaatggccaatccggctggttccaagttggcggaacaagctttagtgcacctgcctggagagcgctcatcgcactggcaaatgaaggacgcacgcaatccttatcaagtgcacaagtccttagcactgtttataataccgccggcacaaccggaagcagcggctatactgcgaattaccatgatattcaaaccggaagcaacggttatgccgcagcagccggttatgatctcgtcaccggcatcggtagcccgattgcagataaaattgtgccagcactttcattaacaaaataaaaatcctgaggctgtcccgaaagcaggatcgggacagccgtactgaaaagaagccgcccaaatgacgtttcagacttttaagagcatcctttataattccatctgattcagtaagtccttcagcgccttcagttcatccgtattcagcgtaatccctttccccattttctcatgttccggcgcccagtcacgcagatcaaatttcggcgcctttccgttccagctgactaagttcagttcttttgtccatccttttggagattcagaaattgttccgattgtttctttgatttcatatttaaaatctgccatgtcaatgaccaccttttcccatcataaaaatttggaaccttactttaatagtgcaggattccggtctggaaatcaatacggttctcatcacatttttatgttcaaaagtattaatattgactttcaatcctgctgacttggctgcctggctgttttaactgcattgccgagcgttgggcaattgtcggatttttcagctcctcgcttttgacaaggtttccggctaaaaataccatcgaatagatttttccgcttccctgtgtatcccaaataactttggcacgccgttccgttccaatggctttaatggtggagagaagcgcttttttcatgccgtaatactggtggatagaccgccatgatttttgcttcccctgtaaagatgcttgagattcgatgaaaacaaataaagcgagagaaagaaaaaattcctcgataatataaggatattggcactggctaaaatcagtggacctcacgtgatagagacattgccattcggaatgcaaaattaatgcaaaaagtttgccgaaacgtctgtttccttccccattctccacaaaaacaaaaagcccgtaaacccagtcatatcaagggttcacggactttttatcccgttctttatttttcttaaaatggagacggtgggagtcgaacccacgtccagaaatatcgccactcaagcgtctacgagcgtagccgatatattcgcatttcgcgcagccatctgcctattggcgggcgtccggtacgctagcctgattggtctcttccttcgtccccaggcggaggacagccggcgtatcccactgaagttgagacccttaccctaccacgtgggcgatggagggaggatccgcttagcgcttattaggcagctaaagcgagtttagtgttagatttgccagttatttttaggcgttgcgttgttacggggacgaccccccggctcgcagcttgagctcgatctatccctgtcgaatccgtaacgtccccgatataaaagggcgcttcagattttacttattactggcctgcatatcctattataacatgaatcccgaaagatgcaattgatcaatttttccgtacgtgtaaagtttttctggttttggaaatgagctgaataggaggtgaagatatgttacgtcatgatccagtgcaattttatatcccaccaagccttttctttcgttgtcggtaatccgctagttaaaaatttattctcggaggctttttcagatggtctttctcgatcattaaaaatatcgatcgtacggaaagaatggtagcgggtaaacaggcgcacataaaaaacacccggaaaatgcggggtgcatgtcctttaatctctcagcatattcaaaatatgattaattttagtgtcatgcttgccggctttttcacttaaaaattcgatatcgccttttacgcctttcagttcatttgaaacaacagtaaaaacttttttgtgctcttccagtttatcatttgtaaatttaaagttgcttcgtaattctaacgtaagattgtcaactttggtttcgatgcgttcctggcctgcttttaagctggagacatcattctttaacccagagacatcattctttaacccagagacatcattctttaagctggagacatcgctttccaaccgatcctggcctgcttttaagctggagacatcactttttaaatcctttagttcactaagaatctgcttcaaaatttcatccatcgtctttccccctttgttgcgtatagcataagtatatcacaaaggcaatttttttactatactctatatttacatttcactgatctatcgtctcgtttccttggcaagcgggatgattattttcttaaaaaggaagaagccgagtggcaaccaacccggccgttacggttctgcagcttaattcccccgtttggcgagcattaaaccgctgttgccaccaatgaaggcaaatatcattaagagcggaaaaaactgtgttggtaaccccttatctttttgatcggtttcatttccaattctgttgcgcttttatcatatcgttcacagcatttttaccgtcctagtagttgatccactgtacctattagaatattatgaaaatgatttcctgtcatgacaatttagaaaaaatactgtgcgagttttcctgacagtatgatacagcagaaaatacatacaatacctcataggtgaaaataatgaatgaaagaaaactgtataagtcccccctttctgccctgctgtggtcggctgcctttccgggcttcgggcagctttacaacggtgattattttatcggatttctgctcatgctttgtacggcagtcatcaatttcgggtcgaacttgaatatgtcggtttacgttgcgttcaaaggaaattttggcatggccagcgaacgattccatcccgagtgggggatttttttcctgccgtttactgcttctccctgtggcaagcctttaaccagtcggtatccattaaccggagattggcatcattgggggtaaaaaagccaaaaaaagcaacacatttaaccggtttctttttcggcatgttggcgggtttccactttggcctcttctggcacttctcttttttcaggttgctcggatgtttgcgtgttctcgatttgccagtgattaatgggctggtgatcggctctatttgtgctgccttaggccactggattgagtctctttgtgataaacacgataaaaagtagatcctttagcgtttcgtacatactcaacaagaaacaaaaaagaaattgaaataaaggaagtatgctttttggaaaagccaacaaattataagtccccggttgcggcactcttgtggtcttttgcattgcctggatttggtcaattttataacggtgactatttgctcggttttctttttatggctttggaattgaccattaaccatcagtcccgtttgaatttggccattatttatgcattccaagagaactttgaaaatgggcatcatgtgattaattatgaatggggcatgttttatccatccgtactctgtttttgtctttggcaagcttttaaccgcgcaaaagaaatcaattggcatttagaacagaaaggggtttcacctccaaaaaacaaagtcagtctcacaggagttctatttggacaagtaataggaatgaattttggcttttattggcaccattttttcttttacgaaaaattccgtatgctgcgctttcttgatattccggttatgaacgcattcgtttttgggcttatttttgctttatgggttatggaatcgaaaaaatttttcgttcgtcgaaaaaagtaaagttcaattaaaagacttgcaagcagtggtactttcttgattctggtaacggtaaaaaaagctcattctgcagggtagtctgaagttttgaaagcagggaggcaaacaatgtgaaagtcggttttgtttataaaaaaagataagccggtattgaaaaacgaacgtttgtcctttataataaaactgaaaaataagaaaaggagtgctgccattggaactggtaatggaaaaacatgccggttatcacgtgcatgatcgtttttttaaggagctgatccaaaacttttttcaggagtttatggaggcgtttttcccggatgtgtcagctgatctcgactaccgccgggtgcggtttttgtcgcaggaacaacgtagggggcgtctatgttaagaaagcgcggaaaaacgacggcctttcttaacgtagggcgcgtctatgttaagaaagcaagcaaaaacgacggtctttcttcacgtagaaggcatctatgttaaggaagcgcgaaaaaacgacagtctttcttaacgtagggcgcgtctatgttaagaaagcaagcaaaaaagagtttctttcttcacctagagcctgtctatgttaaggaagcatggaaaaacgacggtctttcttcacatagaggtcgtctatgttaaggaagcacggaaaaacgacggtctttcttaacgtaggggacgtctatgttaagaaagcaagcaaaaacgacggtctttcttcacgtagaaggcatctatgttaaggaagcgcgaaaaaacgagtctcttccttaacatagggcgcgttttaagtgcaagctttttctgcattttttataaaacccttgcattcaatttttaccaaagctgtcagcatccttgccaaaccttttgcttattcagcaacccttaatttagtgttcgtattttccgattgaataggccgagaatcgaaaaaaggaagattgttatgcctgcaatcactattgtcagtgaaaggttaaccaccttgtccactaaccagccgaagagactgtaactaactggtaatagtaagaggccgaaaaacatttcaatactcgtaatacgccccaaaagctttttgtcaatcaattcctgtgttgcgctttcccatatgatgataaaggcagacaaacaaaacccaaatgctgctaagatgacaagaatcagccagaaaggaggcgtcattgctaaactaatgacaaagagacctgaggctgccataaaagaataataaagtattcctcttttcgctaaacggtcgatccgtccgatgaccagtgcgcaaagaagcgaaccaacggccatactggtcaaaaaccatccgaatgcttcgatgccgtgaacggattttgcataaatcggtaatagaataacgtcgaaaccggcgattcccatattcgccaaagacccaagcagtatcgtagcgcccagccaaggtacttttataagcgtggaccatcctgcgaacaaatccactaggaagtctcccttcttcctactggtttccccgttacgatattcacgtttttgaggtctaacaaaatatactagtaaggcagatagagcaaagagtatagcatttatcgtataagctgaaaataagcttacagatacgacaaggaaactgccgacaactggtccgattattttgctcaattgctgggaaatacttctaagcgaatttgccgacaaccggtacttatcatcgacgatccatgacagcatgctgcgaacagccggccggtaaaatgaactaaaggtgccgagaagtgctgtcaggacatagacataaaaagtggatgcctgatgggccagcaataatccggctattgccgctgctgcgatccctcttaaaaaatcaacactgcttaatatggtttttttcggaattctatcgacaaaaatgccgctgataaataaaaagacgagttgcggaacaataaaaaatgtctgggcaatactcagttccgctgcgcctcctccaacatgaaagacaagaaatgggaggcaggtcgtattaatggaaaaggcaaacattgaaaaactttgaccgatccagagaaaagaaaaagaacgattggataatgcactgaaaacattcggtaccttacgagtcatgatttctctcctttaataagaaaaaagaagaggaatagagctttctcctttaatgcttgttcacttaatactcgcattataacattaaatttaaaaaatgttgtcataattggtcgaataaatgatttgtttaaaataaatttaatttaaaaaatgatgagtaaatagccttccttattgatatcaaattttgtatactcacttaaatcataaaatagaattgcactgaatgttcaagtacagatttatttccatatgtgacttttttaatgtctatgtttattttgttcaccttattttttctttacttctaccactatttttatcggaaatgacgctgcaccacttagttttattttacaagcagctgcctataggataaggggtcttttactaaatcttccagtgtatatttgtcgagcacgcggagataagcgacgagggcttcgtttaaaacatgctttaatccgcaaacgggggagatgatacaggcggaagccccatcttccatacattcgactaatttaaaatcatcttctgttatgcgaatcagttttccgacattaatttcgcggggatgcttgttcaggcatatgccgcctctccttccgcgcactgttttgatcagcccgagtttgcttaactcgtatgtgattttcattaaatgattttttgagatgttgtaggcatccgcaatttctttgatgctggctaattttccttcttccattgaagcaagatagattaattcacgcaaagcataatcagagtaatgggttaaacgcatttgtatcacctgccaaccccattatacccgttcccatcgaaaatggcgctcattttttccttttcggaaaatgtgacaactttattaaagatgtatttaaaatattgctttaaaaacaaaggagcactatcttaaagatatattttaaatattactatttggagagtggaaatcatgttatcgcagaaaaccattgagatcgtaaaatcaactgtgcccgtattaaaaacacaggggacggacattactacatacttctataaaacgatgtttgccgcacaccccgagctgctgaatatttttaatcaaacgaatcagtcacagggaaggcagcaaacagcacttgccaatgctgtattagcggctgcttcttatattgaccatttggaaacgatcttgccggttgtggaacaaattgcacacaaacaccgcggcctgggcattcaaccggagcattatccgattgtcggggaatttctgctgaaagccattaaagaagtattaggagatgcggccacggaagaggttttgcaggcttgggctgaagcatacggatccattgccgacgttttcatcgaagtcgagaaaaaaatgtaccgggaagcggaaaccaaaagaggaggatgggaaggctttaaaccgttcacagttgtaaaaaaagtaaaagaaagcaatgccattacgtccttttatttaaaaccggcggacgggggcccggtgccgtcctatcttccgggacaatatctcacgctgagagtaaaaattccgggtgagacatacttgtttaaccgccagtacagcctttcatgcgggccgggacatgagtacttccggatttcggtgaaacgggaagcggatcatgaaccaaatggaaaggtgtcaacgtatttacatgatcatgtcaaaacgggggatgagcttgagatcagcgcaccggccggcgccttcacacttgccgatgaaccagcaccggttgccctgatcagcggcggggtcggcctgacgccgctgatgagcatgctggaagctttagcggatgccggctctaaacgcgaaatccattttattcatgctgcccgcaatgaagatttccatgcttttaaagcggaagcaaaacaccatattgaaaagcttgaaaacgggcattattatttcgggtacgggcatcccctttatgaaaacagcggctgcgatttcacaggccatctttccaaagcatttttgggaaaggtggtaactgcgcaaacggtttgttatatttgcggtccggtcccatttttgaaaaatacggtgcaaattttaactgagcttggcgtggccaaagaaaatatccgctatgaattttttgggccggcaatcgaactggctccggctgcagccgtttaaacgagcggggggaagagtgaaaggctcactttttcatgccgggacatcgttttcggccagaaccagcaactttttggacgggacagcggattttcaagagaggataaatcctcgcgtttttaaagcgggaaaaaggggctgtcctattttggctcgtgcgctgatgatcgatgaaattcatgaaacgcttgcgggaatagtggctgaatttcaccatcataaacaccaaattggatcatcctttcaaaatgaaggggctcccatcaatcgtttaacggtttttgggagcccctttttcaaaaaatcagcagcaagcttgcgacaattggaacggcaatcatcgaagacttgagcagcgggacgggggcgcggtttgtaaatttggcgccgatgtatgcgccggacattgtgccgatgacgacttccacgagcagcccgagatccagtgtcccttgctggaagctggcgagtccgccgcctattgcaatcgggataatgaccatcatggttgtgccggcagcctggcggacagataagccgagaaggatcattaagccaagctggataaatggcgtcgagccgatcccgaacatccctgagagcgccccggttacgatgccgagcaaaagcgagcgggctacaaaacggggcccggacggaatgctttttgcctggatggattgcttttgcagcaaaaacattctgagccagagcagaaaggctgagaacatgagcatgccggcggtgagccattttagttcgccgcttgcaatatgcgcggagacatgggatccggcccaggctccggcagcgcctatgatgccggttgtaatgcctgctttaatggagacattgccttctcggtaatggcttaccgccccggaaaatgaagaaaagatcatggctgttaaagcagtcgcaagcgcggtatggatcgaaacgccgaataaaattgtcagcagggaaatgataaagcccgcgccgcctgcgccgataaagcctaaaataagcccggttaaaaacatcgtaatcaagatggaaacatgcatggaaaagccttctttcgcattgtgctacttccattttatccggaaccgcaggccttgtcacgctgccggtttttgaaacggcgtggccccatccggaagattcgtgcccgcatcatatgcggctggctttaccatatatgaacggaatattgctgctcttttgcctgtaaagccgccatcatgcaatgggtgccggggcttgatgtattaaatcagaacaatgaaaaggcggttatcagcattctaaaggccagatcgaaaaagcggcgcccattttgcagcatgaaaaaaacggctccattcttgaagaacagggccgttttgggggtttattgcgtaaccggtacagcgagcagcgcgctcagcatccagatgtttttttcaacgttttccacgagcgttgtcgccatgtcagccgtgccataatcctgattgtcttcggcaagtgcgatcaattttttcagttcgacggcgatctgtttgtagtcttttacaagagattccaccatttgttcagcggttaagccggattttgcttcttcaatggttgcaagttcaaggaattctttgaaagaagcagccggctttccgccgatcgcaaggatgcgttctgcaaaatcatcgaccaccgtagcagcttcgttgtacagttcttcaaattttacgtgcagcgtgaaaaacagcgggccttttacataccagtggtagtggtgcagttttgtatacaggacgctccagtttgcaacttgctcgtttaacgctgtttcaatatacattttcattcctccccagttttggtcttgctatacttttattataatatatatcatttaaaagtcaatattaaatgataataattataaacaagttgcgaatggtggtaactttcccggctttatctggtttaataacgatagcaccaggcggcattcccccggccgtcccagttttctccggttttaaaaacgcaaaggcagggacaaggagattcgcttcttgcccatgccgtctgttttcaattttcgcgcggcctgttgcccggtttttgcgcttaagctcacggtacgatccggaatctttttttggcccgattttagtttctgtcggttttaaagataatcccgttttgcttccgcgatttttcgataaccgaaaggacttcataactggactggcgcaaggtttcatacgtttttctgtcattttgcgcgatgatatcggcaaaatcattgatttcatacatcatattttgcgcttcctgcttccgcgagaagaggaccggctcctttgtccgcacatcggcaaacttcatcttttccaattctgagatgccttcaataataatgctgcctttttcgccgtggatttcgctcggaatataagaatgggaaatttttgagcagatcacggtaatattgaacccttcgtattgcaggacaagggtgccagccccgtcaatgccgttccgcaaaaggaccgggaagtaccggctgtctttcggtgcgccgaataaccagaccgcaagcgaaagcggatagacgccaagatccattaatgccccaccggagaagttccgcgagaatacgtttggctcttcgccggcaaggaatttatcgtagcgggaagagtattgcacatattggaaaattccggttctgatctggccaacatcctttaatttttcttttaaaagggcagtattcggataatggatattccggattgcctcaaataaaaatacaccgttctgatcggcaacacgaaaagcttccttaaattcttccgtattcgaaaaaatcggtttttcgcaaatgacgtgttttttgtttttcagaaaaacgagcacttgttcaaaatggagcgcatttggcgacgcgatataaacagcatcaatgttctcgttttttgccatttcttcaagatccgtaaacatattcggtgcgccatgtttttccgccatttgttcagcgctttcttttttgcgcgagtaaacggcttcaagggttaattttccggataattttgctgcttcaataaaagcagaggtaatccagcttgttccaacggttgcaaaacgcatagcatcgcttccttttctcattttatcttgatacgttcattgtatcacatgtcgaaacggttgataaacagtgaggattcgacataaaattttataaataaatggatatttttgttgaaaaagatatatagttgaaatatatatacataatcacaggaatgcccggtcttcatcagacatatattgagcatgaaagttcatttcaaaaaagcttgaaatacggattgatagaaagataggcaggtgcaaaaatatgggtgtcggaaaaatacattatgaatttatggatctcccgctccgctttcatcttttttctgctgttgtcggaatggacggtattttaaaaagcatttcctctgatatgcagacggtaacgggttttgatgccggcgactgggtaggaaggcctttttctgctttgatgcaccacgatgaccacaacaaatgggcaggcattctaaatggagagaaagaagaaatgggccttttcatgtacaggatgaattcgaaaaacggtgattacaaatgggtggagtccacttatgcggtctttaaagatctaaaatatggcgaaaagccccatatccatttgctgacgaaggatatgacggtggtcaaggaattatacgattatcttgtatcatctgaacagctgtccatggtcgggcagcttgccgcgggcattgcgcatgaaatccggaatccgctcacctcgattaaaggttttttgcagctgatgcaggcgggcgtgattgatactggccattaccttgatattatgcaaaatgaaattgaacggattgaaatgatttcaagcgagctgctttttctcggcaggccgaaagcatcggatatgaaagtttgctgcctgcaaacattgcttgatgaagtgcttgttttaatggagacgcaatcgtacggaaaaaacatccaaattgagacggtttttccgtcgcagcccatttttatttcttgtgacgattcaaaaatgaagcaggtatttgtgaatttaatcaaaaacggcctggaggcgatggaagaggggggaacgctgaccgttgaactttcggtggccggggaacgtgcagccgttgcgatccgggatgagggaatcgggatcccaccggaaaaattggaaaaaatcggccagcctttttatacgacaaaagagcgcggcaacgggcttggtttaatggtttgttaccagattgtaagagagcataacggagacatctctattgatagcaaacctggggaaggcactgttttcaccgtggtactgccttgggcggggccggacggggagcagaaggcatccggcagtttttgatgcgtgcctgatggcatccggcaatccatgaaggcaagaagtggccgtttccggcagatttcttccattgagaataaggaaaaactgttgtatgcttatgtacagtctccaatggccggatgatttgtgcattgtttaactgttcattagaaaggtgagggccgatgtaaaaaaacgatgcaaaaataaacctactctacaacgattgaaaggaactgacatatggcaggatttaaagatgaagtgttatcaagaaggacttttgcgattatttcccacccggacgccgggaaaacaacattgacggagaagctgcttctgtttggcggggccatccgtgctgccgggacggtcaaaggtaaaaaaaccgggaaatttgcgacttccgactggatggaaatcgagaagcagcggggcatttccgttacttcttccgttatgcagtttgaatatgtgggaaaacggatcaatattttggatacgcccggccaccaagatttcagtgaagacacataccggacactgatggccgtcgacagcgccgttatgatcattgatgctgcaaaagggattgaggcacagacgattaaactgtttaaagtgtgccggatgcgggggattccgatttttacgtttatcaataaattggatcgccaagggagaccgccgcttgagctgttggctgaactggaggaaatcctcggcattgaatcgtatccgatgaactggccgatcggcatggggaaagaatttctcggcatttatgaccgttatcaccgccgcatcgagcagttccgcgtggaagaaggggaccggtttctcgcgttaaatgaagcgggtgaagtggaaggggatgccccgatcaaagaaaacgcgctgtatggccaggcgttggaagaaatcatgctgctcgatgaagcgggcaatgaattttcggagaagcggattgcaaacggcacgctgacgccggtctttttcggcagtgccctgacaaatttcggcgtgcagacatttctggaaacgtatcttcaatttgcgccgccccctcaaggaagaaagacggacgaaggggtggtggatccgttaagcgaacaattttcgggttttgtgttcaaaatccaggcgaatatgaatcccgcccaccgcgatcggattgcgtttatccgtatttgttcggggaaatttgaacgcggcatgtccgtcacgcttgcaagaaccggaaaacaaatgaaactgtcccagtcaacccagtttcttgcggatgatagaagcacggttgaagaagcggttagcggcgatattctcggcctgtatgataccggcacataccagattggcgacacaatcttctccgggaaacagccggtccaatttgaaaagctgccgcaatttacaccggaactgtttgtaaaagtatcggcgaaaaacgtgatgaaacaaaaaagtttccataaagggatcaaccagctcgttcaggaaggcgcgatccagctgtaccgcacatggcatacggaagattatattttaggggcggtcgggcagctgcagtttgaagtgttcgaacatcgcatgaaaaatgagtataactccgatgtcgtgatggaatcgatcggttccaaaattccgcgctgggttgagggggatacggtggacgaatccctttccagttcgcgcagtctgcttgtgaaagaccgtttcggaaaaccgttgtttttatttgaaaatgattttgcattgcgctggttcacggacaagcatcccgacattaaactgtataatccgatgaattaaaaaacactgtgcggctttgccgtacagtgttttttgcatttttccggggcatgataagaacacgtaaaaacgggaggattatgactagccaacttcagctttaaaggggcatgcgcatgaaaaaattagcaccgcttgaggcgattgtttggaacattgccttgccggggtttgcccagcttttggcgggccgttatgtgaagggcattatgtttctttttatggagtttctgattaatgtgaacagccgttttaacgaagcgatcatgctcagtttcctcggaagaacaagggaagccggcaacattgtcgattacggatggttgatgttttatccttgtctatacttttttgccatgtgggatgcgtacaaaatgacccgcgaccatcttcagccgtatagttatctgccttttgtgtttgctgcttactttgtaacgctcggattaatgctctcccctgcggttatcgtccggcaaaagatgcccgggcctgtttttttcccgatgctttgtgccattcccggacttttggccggcgggctgctccgcataattttaacgcgaaaatcgcataaaaatagttgacggaaatggatggatcccatataatcaaaataacagaatacttttgacaattgtcaaaggggagtagcgttaagtgtgcatggcacacttaaaacaaagtcgtcattacatgatccgtttcggcggtcatcggctttgttggcaccattcggatgtctagcaagacctttgcctgtactggcaaaggtcttgctttttgtctttacaggaaattgtcaaaagtggcacttcactgatcacgccggtacgcgtcttggaccggaatgccgcttttgatctgtaagggcaatggttccgggtgccggcaaaggaggactttgtggaatggatttatcaatgctattcgaatatgcatgggtgttatgcgtattggtcggactggaaggaattttagctgcggataatgcggtcgtgatggcggtgatggtcaaacatctgccgcacgcgcagcaaaaaaaagcgctcttttacgggcttctgggcgcatttgtattccggttcactgccctgtttctcatttcgtttcttgcaaacatatggcagattcaggctgtcggggccgcttacttgttttttattatgatccaccattttgtaaaaaagcaccgggaaaatggcccaaaacttgccgaagccgcatcgaagccggtttctttctggatgaccgtttttaaagtggaactcgccgacattgcgtttgccattgattctatgcttgcagctgtggccatggctgtgacgctgtccccggccggctcgtttcaaattgggggaattaacggcggacagttcagcgttatgtttttaggcggggtgatcggactggtgctaatccgctttgctgccaaccggtttgtccgcctgctggaaaaatatccgggccttgaagatgccgcttttctgattgtcggctgggtcggggtgaaattgctcgtttttacgctttcacacccgggcgtcgggctgattgatgaacatttcccggagtctgctttgtggaaactgattttctgggcggtgatgcttgcgatcgcagcgggcggctattttttctccgtccgcaaaaaaaatcgcaataaagaggcgcaatccgccgggaaatcgggtaaaaagcagcaacagatgtaaaaaaaccggcaaagcaggcgaatcccgctttgccggtttttcttttattccggattttgccccaaaaggcgggactgggcctcgcgcacgagccgttttgtcatttctccgcctaccgatccgtttgcccgagatacggtatccgatccgagctgcacgccaaattcttgcgctatttcatactttacttggtccatgtatgcctcaatccccggtaccaacaatttattgctgtttctcgccatcatcattctccttttttaaaaaattggctcctctttctgccgcccgtattgcggcttcagcctttatgaatagtatcggcttgcaggaaagaattatgtttggaaacagttgtatttgcatgcaccctgagccggttttgacagatattgcagccataagggcggtggtgcgcgggcatgctaatgatgcaggcaacctgaaatggaggggacggcatggcgaaacgaaaagcggaatttgatgcagccgcgaaaaataacaaaaccccgaaagagaatctggctgaaacagctttctccacggaatttgcccgcggggaagaagcggtgaaaggggcaaaccggaattcaaaaaaaggcaggaaagggcgttcatgaaccgcaggaaacaaaatgtccgggaagaagcggggctggaattcggggacatcaatgccgggaagatatatgaaatcatggctgaaagcggaaccggcaaaaaaagaaaaaatgcaaaaaaaaataaaaaatgaggatggcagccgccatccttttttgcggaaatggcagcaggaattcccccgttggaccacgaattatcaccatatcatccatcttgccaatttcatttgacatatcttctcaaaaagaatatgttcttaaatagcagctggaaacccttatgcagcagacttttccagacatttgttgtgaacagaaatatcataaattcaggggcatgcttcttatgaagaaggggagaacaaatttgggaacagatcagtttatgagccaaaagaaaaggggacttgtattaagagatcatgagcagctttaccgaaccctttttttggaagcaatggatgcaattgtattttgggatcaaaacggccagatcctgttggcgaacgaagccgctttaaaaattttcgagtgtacaatggaagagtttgtcgggaaaaagctgagcgattttgtttatgtcgaaaacggtgggaattgccggaagttcgacaggctaaaccaaatcccggcggcccgcgaagaactgctgtttaaaatgccgaacgggcagctgaagcatctcgagtttacatcccggtatattagcgcggaaaattaccatatgaccatttttcgcaacgtgagcagccgttacaagatggaacagacgctgcgggacagcgaggaacggttccggaaagtgttcgaaggatcgatcgacgggatggtcttatggaactgggatttgaaaattgtcgatatcaaccctgcagctgcaaactatttcgactgcagccgggaagatgcgatcgggaagagaatccagaatttattgcttaccaatgacgaaaaaatgcaaaaagattttctccgccatctttttcagttaaaagagaacgggacggcagattatttgtttactgcttcaaaagccaatgaaacgaaatattatgagattacgtcaaaagggaacctgacgtcaaatatgaatttaacggtcatccgggatattactgaaagaagggcgatgcaggagcagcttcgcaaatcggataccctgaatattgtcggggagctcgcggccggcattgcccacgaaatccgcaatccgatgacggctttaaaaggttttatccaattgctgcaaaacagcatgaaagaggaagagcattcattatattttaatgtgattacatcagaactggcgcggattgaagcgattattaccgactttctggtgctggcaaagccgcaggcaatccagttccaaaatcatgatatccggaaaatcatgcgcgatacgattggtttgctgaatgcgcaagcgctgatgcacaatatccagatttcctgccgctttgacgatgggcttccggatgtttattgcgaaggcaaccagcttaagcaggtctttatcaatatcattaaaaatgcaatagaagtcatgtcggacggaggaaaaatagatatcaagatttgttacgaaaaggaaagagggctggtccatacaagcattcgcgatgaaggggaaggcatcccggacgataaaattgaaaagctgggcgagccgttctatacgacaaaagaaagaggaaccggactcggtttgatgatcagttataaaattataaaggagcataaaggcttcattcaagttcaaagcaaagtgcgggaaggcacaacttttcatatctttcttcccgtgcaccaggaagcaggtgatgaaaatggcttttatttggctggaaagcccaatcggacctttaacagtaagggcgaatgaaagaggcattacggccgtttctttcggcaaaacagatgaagagggtatgccggaaccccgccacccgctgcttttgcgcgcagccagtgaactggaagcgtattttgcaaagaaaagaacccgttttgatgtgccggtttctgtctccggcactccctttcaaatggcggtttggaaagcgctgaaacaaattccgtatggagaaacgtgctcgtatcaagacatcgccgaggcggtcgggaacccgaaagccgtgcgggccgtcgggcaggcgaaccggaaaaatcctgttccgatcctgatcccctgccaccgcgtgatcggaaaagacaagtcgttaacaggctatgccgggagccgcatcgatcaaaaagcattcctgctccgtcttgaaggggcgattgtctaaaaggggtatcgtttttcaaagtcccgcgcggccttaaagttcaacttttctctcttttgtttttccattgcaaaaatttttccaaatccggggtcacttgcgtcagaagaaaagcgagcacggcggtatcgtcaacaaggcccgcaccggcaagaaaatcagggatgatgtcaatgggagatacgaaataaataaggccgattacaatcatgagaatcgtccggtacggaacagtgcggtattcgccttttgcccatgccctgatcagctggaaaaggatgcggattttactccacatattggcgagcgtgattttgttggagagcgcttttttctccgcacggttaaccagatcgccggtttttccccggtcatttaaatactgttttgcttttgaacgaaataaccacccggctgcttttgccagcagaaaatttttagccatctgcttcacttctttcatgtctttttctcttttatttttccactgcatgaccaaaaaaaacatagagctgtaaaaaacgggtggttttttcgggagatgtgaaaatttttggtgaaaattttgtctaatattgcgattgtatttacatttccgtcaagacctgcgatactactttagtaatggtaaaataagcaggatgggggcagggcttttgcgcctttccggcttgcagcgcaacttttgtcacgatgccatcaagcggaaaaccggcagtatcatccgccattttccatgtgtaacacctcacatttttgaagcataatcgggggataacaatcattcaatagaaaaagagaactaaaggagaattttgaagtggacacgcacatgttagaggagaacaagtatctgtacaggattcagaaaaaacgccaggaaatgatggaacttgggaaaaaactgggcctgacgcatgagaaaacggttcagtgcagtcagcagctggattcgctcatgaatgagtatgaagcctatcggaagcagtacaatacccggtcatccgaaatggtgattattcgggaaatgtcattcatattgtatgaaaaagtgcagcggctcaatttggctgaagcgagaaaaacgtataaagccatgcagattgtttaacgaacaggggaactgcttccaaccttttgcatcttgattttgctcctttgagtgcggatgaatccctgatcaatattccggatgaatatgtttcccgcctttttgtttggactggttttgtgccggggaatagaacccgaccttcttccgattgattacaacaatcaggtttggactgcgttcgatctatttacaggcataaaaaaatccggcagacggcccgtgttgtccatctgccggaatgcataaaaccggcatgggctgtgtccgcatgccggtttttgctttatttttccgcgatgacaatgtcgccttcgcgaacttccgcttttaagtttttgctttccggatggtcgaggataaagtcggcgatccggtcttcgattttttcctggatgacgcggcggatcgggcgtgccccaaatgccgggtcataaccgagttcggcgattttttctttcgcttctgctgtcacgtcaagtgtaatcgcttgttcgttcagcgtttcatccagttcaccgagcatcaggtcaacaattttaaccaaatgttctttttcaagtggtttaaattcgacaatattatcgaaacggttcagaaactccggtttgaagaagtcgccgagcgaatcgagaatattcgattctttgatcgcttcgcttttagcaaatccgactgttttatgcttaaattgggtgccggcgttgctcgtcataatgatgacggtatctttgaagctgaccgtccgcccttgggcatcggttaagcgcccgtcatcgagaatttgcaggaacatgttcaaaacatccgggtgcgctttttcaatttcgtcgagcaaaataatgctgtacgggttgtggcgcactttttccgtcagttgtccggcatcttcataaccgacatagccggcaggtgccccgatcagtttcgagacgctgtgtttttccatatattcgctcatgtcaagccggatcattgcatctttcgtgccaaacagttcttccgcgagccgtttcgtcagttccgtttttccgacaccggtcgggccgacgaacaggaacgaaccgatcgggcgactttgcgctttcaggccggcacgcgaacggcggattgctttcgctactttccggacggcttcttcctggccgatcacctttttagcaaggttttcttccagatgctgcagttttttcgcttcatccgcttcgagtttgccgaccggaatacccgttttcttttcgacaatttcctgaatttgcatgacatcgacaaccggtttggcttcaacttggccggaagtagccagctcgttcagtttttgttcttcttttttcaattcagctgctttttcatagttttctgttgcaagcgcagtttgtttttcctgtgcaatttcagcaagccgtttttggatatcttctttgctcggaaccgcaatcgtcaggttcaatttcgaaccggcttcatccatcaggtcaattgccttatccggcaggaagcggtcctggatgtagcggtgcgacaatttcgcacaagcttcaagcgcttcatcggtataggcaacgtgatggtagttttcataccggtcttttaagccgcgcaaaatcatgacggtttcttcaagggtcggttcattgacttgtaccggttgaaaacgccgttcaagtgcggcatctttttcaatttgccgatattctttcaaagttgtcgcgccgatcacctggatttcgccgcgggcaagcgccggtttcaaaatattgccagcgtccatcgaaccttctgcagaacctgcgccgacaagcaggtgaatttcgtcaataaacagaagtacgtttttccgttgttcgagttcggcaatcaattttttcatccgttcttcaaattgaccgcggatgcccgtgtttgcaacaagtgaagccacatcgagcaagtaaacttctttatgccgcagtttagccggaacttgtttttcaacaatttttaaagcgagcccttccgcaatggcggttttcccgacgccaggttcgccgattaacaccgggttgtttttattgcgccggtttaaaatttcaatgacgcgggcgatttcttcatcacggccgataacagggtcgatttgcccggcccgtgcagcggcggtcaggttgcggccgaactggtcaagtagtccgttgccaccgccttgtgtttgcgtttgtacggtttgtttcgcgccgttcggctggaacccgttggcattcatttggttaaagaggtcgttgaatcctccgaatccgaagtttccaaatccgttattcataaacatgcctccccagttgttttcgaattttgcacgttctttttggtagcaggactggcataggttcaatgttttttggtttccgttcacatttatatgcattccgatcgtcgcttcgttttgatggcatttgtcacataacatcaaacattcctcctttgatcggtttgattttgactatctttgactaatgagattgaaaaacaatcaaagcgttttgatttgctttgaccttgattgggaatgagtatagctcaaaatttcacaagatgcaaatcttttgcatgcacctctttgatgcattttggcctttccagcacaatggcaaatttgtcttatgctgaaaacaactaaatggatctgcgtatcaccttttgactatctttgacctttctaatatcagtatacaacagcgcggtccgaaaatcaaaagatttgcatttgccattaacgcttatcagccaatggtgtcatcttttatttgaccaactttgacctttgcctatagtataggacaactttttttgcttgtaaaggggcttttgactttttttgaccaattttttaccggcggaaatgaaccggccgggctattttaagaaagcgggacataggatagtaacggagctgacaggttgtcttattttttcttaaaggggtgcaggcgttgaataagtggggcggtgctgtccaaatcgcagccgtttatattggaacggtcatcggagcggggtttgcaacagggaaagaaattaccgttttttttacacagtttgggctgtatggattgcttaccatctgcctttcagggtttttgtttattttctttggtacgaaaatgatggaaaaagcgatcgatttgcatgcggattcctatgaaactttaaaccggtatttatttggcaaaaaagcggccggtttcgtgaatgtgatgatgatggccatgcttttcggggtttgcggcgtcatgctgtccggtgcgggtgctgttttcgaggagcagcttcatattgggagggaaatagggattttattgacggtgcttcttgcctttcttgtcatgtgttttggcatcaaggggctgcttggcgtcaacacatttgttgtgccgttgatgcttttgtttaattttctgcttttgtcgcagtccttccagtcacccggtttttttcaagcgctcatggcccggccggaaagtgttgatatgccccgtgcgcttctccgcgccctttcctatgcggctttgaatttggcgctcgcgcaggcggtgcttgtcccggttgcggcggaagtgaaagataaggaagtcgtccgtgccggcgggatactgggcgggctgtttttaacgctcatcctgatttccagccatttgtcactggtcacgctgccggacgttgcccaagtggagattccgatggcgcatattgtgaaagcgagttttccgggcatttattttatttatgttctgctgattttcggggaaattttcacttctattatcggggatgcctacgggcttgagcggcaaatgcaaaaatatatcccgatgaaaagcggtttgctgtacgggttgattttttccgccattctgctgatcagcagcttgcattacggcccgctattatcggttttatatcccttgttcggctatttcagccttgtttttatgatggcactcggaataaagacgatccgggggtgaccggtaaggcattcaaaacagctttgcgcggttgttatgcatttgtggcgggcaaatgccgaaaaaagccgtccccctgcttaaaaaatcggcaggaagacgacaagcagcaaatcaaaggtaagatgcgacaaaatttgtgcagacaggctccgtttttttgcatacagtagcccccagaaaatcgaaccggcaaaagcggcaatgaccatgatttttaatccgcagtaaaaataaacggatgcgttcaatacggcggaaatcaaaatcgcatatttcgcttccatcattttcatgagccgggcctggacaaatgaacgccaaaaaatttcttctccggggatgagaatcaggacaagcgctaagtaatgccagaaggattcgggcgaaaaacgcctgtatgcgcgggcgacttcattgtcaagcccgcccggcaaaaaaccgagtactgtattgccaattctgaaaataatatagaggagaaaacccgaaaagatgccatacaacagcaattgaaggtacggaagcttttcgtgtttttctgattttccaagaaaaaccgtgtaactgatcaaaaacagcattgctccggaatataaataccaaaaaacggaggtatcccgaaacgtaatatatagcagaaggtgggcgatcaagatacttccgagaagctttgtatccaccatgttttttgccaccgccaatgcgctcctttcttaagttcgcaaaccgccggcaaaaaaccgggaagggccaaaaaaagagatccggccccgcagtccggccttcgcggcattgggtcaaacaaaaatacagtgaatattttagcagagaaatagggaaaaaggtatccgggaaaataatgttaaaaaattcacaatcatagaaacggcagtaaaaaaaccggcatgtgccggtttcttactgcgcggtaagcgtttgaattaatgtaaagccgagtggataacctgatagtttttatgattgaccactgttttttcatcaagctccagttcctgatagttttccatataggttaaatccacgatgaccgagttctcgttcaccttttcgacaattccttgaagcccatctttaaattcaataatgtcaccaatttgtgcttttttcattgcggtcctcccgtaagaaagtattgtaaccagtttgcactatttttctgaaaagttcaaggcgaaaggaacagaaaaatacaaatcgggccggttttaaaaaatcgcgaaagcaaacaagtaggcggcaggaagaatgtggtacaataccgggtggggtggtcgtatgttggaagaagaaatcagacaggaaatcaaccggcttcgcaacagggaaatcgaagaattattcgtcagccgtgaagattttatggacttccggaaagtgcttattgccgaggaagactttaaacattttaagggcattgccttgcgcggcgggaatgtccgctatatttatttggacgagccggaaatctgactggggcatgcataattttgtgcatttttaagcaaaatgaagtcaactctgatgattgttttatttggaaaggcatgttattctattacggggattttgtttttcccgcactgtgcaatatttgtcatttttttgatccggccggggacatgcgtgttcccggtttcgggcgaggcgtgtttttggcacggatgggccgcgcggactttgagggagcagcctgctgaataaccggggatgaacggtgtttgcaggtatcccggcatcgctgcggtttttttcaaccctcgtttgcaaaatttgtcatttgtatgaagatggttgataaatattgacgaaaaatgtacagtgcattatttttagaactatattatagaaaaggagtcgttctacccatggctgaaaaacaatttaaagtaacagcagatacaggaatccacgcacgtcctgctacattgctcgtacaaacggcaagcaaattcgattcagatatccaattgcagtacaaggataagaaagtgaacctgaaatcgatcatgggggttatgtcccttggaatcggcaaaggcgccgacattaccatttctgcagaaggcaacgatgcacaagatgcattgaacgctttagctgaattaatgaaaaaagagggtctgggcgaataatgtcaaccattttaaaaggtatagcagcatccaacgggattgccatcgcaaaagcatatcgtctggtagaaccggatttgtcttttgaaaaaaggtctatccagaatgtttcggatgaattgaaacgctttgatactgctgtgtctgaatccaagtctgaactgcaggcgatcagggagcatgcaatgaaggcgctgggggcggacaaagcagcgatctttgatgcccatttgctcgttttggaagatccggaactgttgacgccggtccaggacaaaatcagggatgaccaggtcaatgcggaatacgcattgaaagaagttgcggatatgttcgtgaccatgttcgaacaaatggacaacgaatatatgcgcgaacgtgcagcggacatccgcgacgtgacaaaacggattctggctcatctgctgaaagtggatattccgaatccaagcatgatctcggaagaagtcattgtcattgctgaagacttgaccccttctgatacggcgcagttgaaccgccagtatgtaaaaggttttgcaacaaatgtcggcgggcgtacgtcccactctgcgatcatggcgcgttctttggaaattccggcagtcgtcgggacgaaaacggcgatccaggatatccaaaacggcgaccttgtcatcgtggacggcagcaatggcgatgtccatgtgaatccgacacctgaagtggtcgatgaatacaaacaaaagcaggaacaatttgaacggcaaaaagccgaatgggcgaagctgatcaatgaaaaatccgtttcgaaagacggccatacggttgaactggttgccaatatcggcaccccgaacgatctcgacggcgtaatccggaacggcggggaaggcgtcggcctgtaccgtacagagttcctctatatgggtagggacgaacttccgtcagaagaagtgcaatttgatgcctataaagcggtgcttgaaggcttaaaaggcaaaccggttgtagtccgtacgctggatatcggcggcgacaaaaaactgccatacttgccgcttccggaagaaatgaacccgttcctcggcttccgtgcgatccgcttgtgcctggacagacaggatattttccgcacccagctgcgtgcattgctccgcgcgagcgcatacggcaacctgaaaattatgttcccgatgatttccaatctggatgaattccgcaaagcaaaagcgattcttttggaagaaaaagaaaagcttatccaggaaggcgtgcaggttgcagatcatatcgaagtcggcattatggttgaaattccttccactgccgtaatggctgatttgtttgcaaaagaagttgatttcttcagtgtcggcacaaacgatctgatccagtacacgatggctgcagaccgtatgaacgaacacatttcgtatttgtaccagccgtataacccggccattttacgccttgtgaaacgcgtcattgacgcggcgcacaaagaaggcaaatgggccggcatgtgcggcgaaatggccggagacgaaatcgcgattccgattctgctcggcctcggccttgatgaattttcaatgagcgcttcttcgattttaagggcccgttcccaaatcaggaacctgaataaggctgatatggaaaaactggcagaagacgttttgaacttcacaacgaacgaagaagtaaaagaacacgtgaaaaaagttctttcaaacggataaaaaaattttttcaaaaacaggtttaggggtgaaggaagcgggtatatgtaaaccatcccagcattaagggtagtattattggtatccagtattgttacaataccggatgtatatcgtttctttctcatttttccccctatttttgccgagtggctttgccattcggctttttttggattgcgctttggcggagcgcacatcaaaatgccggatatccaattttaacggaaaaatggtggggaagccggtttgaagctttatcgtgtatggatggggaaaaatcgtttataatgaagacaggcttttgtgaacataagatttcggggagggattttgaatggatttaggattaaaagggaaagccgcccttgttgtcgcttccagccaggggcttgggaaagcggtagccaaacaacttgtaatggaaggcgcagatgtccttattacaagccggaatgaagaaaaactgcaggcggcaaaagaagaattatccgcttacggcaccgggaaagtagcgtatatccgggcagatattacccatccggaagatattcgcgccatggtgcaaaaagcacgggatacattcggcagactggatatcctggtcaacaatgcaggaggaccgccggccggaagttttgaagatatggcggatgaagactggcaaaaatcattcgaactgaatctgctttcgtacatacgcatcatcagggaagcattgccacttttaaagaaaaacggcggccggatcatcaacattgcctcttcatccattaaggagccgatcccggggctgatattgtcgaatacattccggacgggcattgtggggctttcgaaaacgctggcggaagaatttgccccgtaccaaatcctcgtgaatacggtcggcccgggcagaattgcaacggaccggatcgtccatcttgacaaagtgacagcggagaaaaccggaaaatcgatggaagaagtccaggcaaaggaactggagtcgattccgctcggcagatacggcgaaccggacgaattcgggaagtttgttgcgtttctggtttctgaagccaattcctatgttaccggaagcagcttcctgatcgacggcggaaaagtcaaatcgatttaatttgccaggtttaaagcaggctgtgcggggtataaaatagaggaaagattgttttcttccttgtacccccatgtttgcttttggcctgctgtgatgcaggcttttttgtttatttgcgaaaagggggacccatgatgaaaaagatcggatttatcgggttaggcgtaatgggccggagcatggcgcaaaatttgcgaaacgcaggatatccgctttttgtctataaccggacaaaagaaaaagcggagccgcttctcaaagcaggagccgaatggtgcagcacgccggcagaaacggctgcaaaatcagatatcgtcattacgatggtcggctatccgcacgatgtggaagaagtgtatttcggggaaaacgggctgcttggcgcggcgaaagaaggaacgatcctgattgatatgaccacttccacgccgacccttgccaaaaagattgatgaagcggcgaaagcgaaacaggtgaaggcgcttgatgcaccggtttccggcggcgatatcggggcgcaaaaaggcaatttgacgattatggtaggcggcgaagaatcggtatttgaagaagtaaaaccggttttttccgtactcggggaaaatatcgtactgcagggcggcccgggatccggccagcatacaaaaatgtgcaaccagatcgccattgcctccaatatgattggtgtgacagagtcggttgtgtatgcgaaaaaagcagggctcgatccggaaaaagtgctcaaatctatcagcgccggggcagccgggagctggtcaatgtccaatcttgttccgcgcatgcttgcgggcgattattccccgggcttttttatcaagcattttattaaagacatgaaaatcgcccttgatgaagcggaaaaaatggggctcgacctgccggggcttgcactcagcaaaaaattatatgaagaactggctgcaaaaggtgaagaaaacagcggcacacaagcattgattaaatattggtccaagtaaagtttgcccgccggcatatgccggcgggcttattttttatgcgggcgggatcatcctggtcgggtcatatgcccatgttccagcaaattttgttaacacgggaagccattatggtttaacgcgggcttctgtccttatggcgaacgcggcgccagcaaggaatttcattttcaacatgacgcccattgccatggaatgcggcaccagcagaaaatcagccggcacatagtttcaggatagatttgcaacaaacttttccatgcgcgcaagccctttttcaagttgatccatgctgcatgcgtaagacatccggaaccagccttcgccgtacttcgaaaaagcgctccccgggacaaccgcgactttttgctgttttgccagatccagcgcaaaatcgaaagaggaccgcttccacgcttccggcacctttgcgaatacgtaaaaagccccgtccggtttcacatagccaatgccgatctcatccagcctcctgcatacatagtctctccgtttttcatattccgttttcatggcatgcgcgtcatcgatgccggctgtcagcgcttcaagcgccgccatctgggaaatagaaggcgcgcacgacacattatattggtggacttttaaaatatgctttgtgagccattccggcgcaaacacgaagccgatccgccagccggtcatcgagtgggactttgagacgccgttaatgacaatggtctgctccggcaaaaacgaagcaatcgagacgtgctgcagattgtacgttagctcgctataaatttcatcggccagaatgaaaatatcacggccgcggagcaggtctgcaatttcctgcaattccgccttttcgagcgtaacccctgtcggattggaagggtacggcaaaatgatgcatttcgtttttgctgtgatagcctggcggatgagatccgcggttagcttaaaccggtttgcccttgtgtccacgtgcaccggaacggctcccaacaggcggatggccggttcataccccgggtaaacgggcccgggcaggatgacttcggaaccgggtgtcaatacggttctgagcgtaatatcgatcgcctcgctggcgccgatcgtgacaatgacttccgtttccggtttataagacaggttgtatttcgtttttacaaattgtgctgcagccttgcgcaaagcaaggtcgccggcattgtgggtataggttgtcttattttcttcaatggcgcggatccctgcttgtttgacatgttccggcgttttaaaatcgggctggccgattgtaaatgagaccatgtcttcgattccggcaaccatgtttgaaaacttgcggatgccggatatttcaatctcccgcacatgcgggttcagtaaatgttccaaaaccggtttcctcctctttcacgaattgcttttcattaaatatgtatgtcctgttcttcttcatcttaccacgcttgcacatttgtgaaaaagcaatcttttccgtttgcccttttagaggtgaaacattctggtccatctgccgatataattcatgtgggcaaatattgagaatcgggcagtccgcaaaatgctccgcgccggattttcatacgttttagaacgagggggcaaaaaaaatgagtctagagcacgagattttactggaaagcggcacaaacgaagttgagatcgtagaattttctgtcgcacaaaatcattacggcatcaatgtcattaaggtgaaggaaattatcatgccggctgcggttaccaccattccgcacgcccatccaaatattgaaggcattatccagctgcgcggggaaatactgccggttgttaatttgcgcaaagtactcgggcatccgcctgaaacgggcgaggatgacaaatttatcgtgacggagttcaaccagcaaaaaattgtctttcatgtggacaatgtttcaaaaatccaccggttctcctgggatcaaattgaaaaaccgtctgggatgtatgcgggcaccgatacacaggtgatcggcgtgatcaagaaagaagacatgatgattttgctgcttgattttgaaaaaatgattgcggaaatcaacccggaagccacgatccgggtggaagaagtcaaaaagcttggaaagcgggagcggaacaataaacggattgtgatcgcggaagattccggcctgctcagggaattgctccgcgatacgctgcttgaagccgggtatgaacaaattgcgttttttgaaaacgggaaagaagcattcgaatatttatccgggattgcagaaagcggaaaagagattaaagatgaagtccagcttgtgattacggacattgaaatgccgcaaatggatggacaccatttaacgaaaaaaataaaagaagatcctgcattaaaagtgctgccggttatcatcttttcgtcgctgatcacggacgcattgaggcataaaggggaaatggtcggcgccgatgcccaaatcagtaaacctgaaatcaaccagcttatccttgcgatggacgaaaaagtgctgtaaacgcagaaaagcccccggctaatcgcggagggctttcctgtatggttgcgtatcgtgattcatctggaaggggtcttttacccggttttgcaaacggattttcccgttatttggtttgcgcttattgcggcttagaaaaaggagtcacccaattttttaaaaaccggtttgcaatttttcctgccggtgcggggctgccccggatgctgttgtttttccgtgagcccagtatactgctcgagcaactgcttagcctggcttaaaggcatgcggcatttcgggttccttgttttatggtccaggtatccgagatgggggaggtttttaaaatcgtcttttgacggcggaatatggaatgtataatcaccgcactttacaagcacatcagactgctgctggctgtactttggatgctcggaaaagtgtagcccgactttcagtgctttcccttcccggatcattttttcaagcgcttttttctttaaaaggtaaagaaattttggattggttgcggttttcgcatggcgattgaccgtgaatacagcataagagaggttttcgattgtaggttgtaatggagcaggtttatgcgaattcaaatagagaactcctttcatttttaatcatattattttttagtcaattatactacttttcgtttattttggaaagaaagcaacatgaaaatgtccatttttttacatacttctgcggccgtttgttttataatggttcaagagtgacgtgatcacaagcttgggaggaaaccagttcatgaagcgattggtgcagttgaaatggattgttgttttagtatgggcattgatcagcattttattggcatggaaagcgccggcaatggaaccattagtcagggaaaaaggccagattaaggttccggaaggttatgcctcgcaacgggcggctgaaatcaaaagccggcaccagcagacagaaaaccacggtacaagcgtcatcatcgtgttccatgaccgggtaaaaatatccggccatgagatggggcatatccggagcacacttgaacggctggaaaaaaataaaaagcaatatgcgattacgggcttaacaacccattttcgcgagccggcccttaaaagtgagcttgtctccaaagacggaaaaacggtgatggccattgccagcgtggatccgggcaagaagtcttttaaaacagtgcgcgcggctttgcagaaagcggtaaaaacgccgggcgtcgaggtgatgatgaccggcaacaggctgatcaatgaagatgtcacggacagctcacaggcgggcttgaaaaaaacagaagcgattacgattgttttcatcctggccgtccttgtgctcgtgtaccgttcaatcgtcgcgccgctcatcccgctattaacggtcgggctttcttatcttgtcagccagtttatcgttgcgatactcgtcgacaagcttgattttccggtttcaaattttacgcaaatttttctcgttgctgttttgttcgggattggtacggattattgtattttgctgctcagccgctttaaggaagaactggcggatggcaaagaaacattgccggccattcttgcgacttaccgttcggccgggaaaacggtgctgttcagcggcattgccgtcctgatcggttttgcctcgatcgggcttgccagttttaagctgtaccaatccgcttctgccgttgcggtcggggtagccgttttgctgcttgccctgttttcgattgtgccgttttttatggctgtgttaaagaaagggctgttctggcctgtgcgcggggacatttcccaccatgaaagcaaaatttgggaacgggccggcctttttgcgctggcaaggccgtttctttcccttgcgattgtggcggtgatcatggttccgctattgatcagctataacggcaagctgtctttcaattctctcgatgaactcggggacaactacgattccgtaaaagcgttcaacatcattgccgaaagtttcggcgccgggaaagcaatgccgaccgaagtcgtcctcgagaatgatgagcctgttaaatcaaaagactatctcgctttaatcgagaaaatcagcgcggatctggataaagtcccgcatgttgcacaagttcaaagcgcgacaaggccggacggttcggtaatgaaagaaatttatgtcaaaaaccaggccaaaacattgggtgaagggctggaaaaaagccataacggcattcagaaaatcaaatcaggattaacgggggcatccggttccctggaaaacgccaaatcaaagtttaaagaagcaaccgacgggatcggggagctggaggccggttcagagaaaatctcagccggcatggggaatctgtcaaactcgctcagccggattgaagaaggcatccagagcggttcggcgggcgcggacgaactgaaaagcggggtaaaaaatgcccagcagcaggcaaaggaactgcagtccggttttaaccagctgtatggaaaataccagctcgtccagtctggcatccgccagtttatcagccaaacggaccagttgccggctgatattccgaagcaggtcagctccctgcaagcggcttaccaggcgtttttaaaagataatccggaagcagcgaatgacccgcaattccaaaaagtgcagcaggcgatgaatgagcttgggctcggcgccggtaatgacaatgataccattgtcagcctgtacagccagattgatgccgtcacagcaacattggaaagcgtggacgcaaaactttcagcgatttcagccgggcttggccgctttgccgatgggtttacgccgatcatcaacgggcttgatcagcttgaaaccggtttgaaccagaccgcagcaggccaaaacgaagtgatccggaaaatcccggcactgcaaaaggggcttcaggggatcgcggacggccaggcacagctgaaaaccggcctcacgacgtttggaacccatatgaatcagctttccgatggtcttgataaaagcgcagcaggactcgggaaaatcgaatccgggttgtacgatgccggttcttatctgaatgatttggcagatgaaacaagtatggaacagtccggcatttatattccggatgccctgctttcaaatgcggattatcagaaagcgctgggccattatatttcgaaagacggaaaaatggtgacttttcatctgatattaaatgaaaacccgtactccaacagggcaatggctgatattagtcatatcaaccgggcattaaaagacgccgtaaaggggacaaaattagaaaatgcccacatcgggatcggcggcgtgtcaagcatcaaccgcgatttggataagatgtcgaaagcggattacacgcgtaccgtcacttttatgctgatcggggtggccgccgcgcttttgattttcttgcggtcgatcgtcatgccgctctatttgctggcgtcccttcttatcacttattttgcatctgccggtttaacggaaatcatttttgtccatctgctcggctatccgggtatcagctgggcggtgccgttcttcggttttgtcattttaatcgcgctcggtaccgactattccatctttttaatggaacggttcaatgaataccagcatttgcctgcagaagaggcgattttgcttgccatgaaaaagatggggaccgtcattctttctgcagccatcattctttccggcacttttgcggctatgatgccgtccggcgttttatcattgctgcaaatcgccaccctgacacttaccgggcttctgttttatgccttgatcatgctgcccttgtttgtgccggtgcttgtaaaaatgcttgggaaggcaaattggtggccctttatcgcaaatcagaagtaaaaaaggggcaacaagtgagcgacgggcggatcactaccgacggaaaaagacaaaaaccgggagtggcgggacccggcaaatggatggccggcctagaaggaaagcaacggccgcggatttcccggccgcactttccgccccggttttttgtattttaactatgcttttcgtacatttctctgtaaaatagaaatatactttcacctgagtttttcagcgtcagcaagcattttcttgatcagaaaaaggatgatattatggacaaatcgaaagctgaaggacaaacaaagaaattccaggaactgccaatcgatgtttttttcagccgcgattttctttccaagctttccgagacggtcagtgttttgaaagtggagaacgggccggcgtttaagtttgtttatgtgaacaaagaagagcagatggaaaagaccggaaaatttctacaggatgtcctcggggaagaggaagccgcccggtttgcatatttttgccaaactgcgctggaagataacaaagctgtcgacttcattcatcattcggatgcaaggcgcatcctccatacttctttggccggcatgaacggcggagagtgggtgattgccattacaagggatgtgacagcactgctggatggcgaacggatgcttccggatgcacgtacatatcagcttgaccctttaacaggcctttggaacaggcacgctttgctggatcggttgaacaggaaaacggcggaagcaaaaaaaggcgcgccccatccggctgtattatatatcgatcttgaccgttttaaattttttaacgatattcttggccagcatgtcggcgatgaaattttaaaacggatagccatccgcctgaagcagctccccttttcggattacgaagtgtaccgccaaggcggggatgagtttatcgtgcttacggccgggcgctcacgggaagaagtgaagcaaatggcggaacagatcctggcgctcttttatgacccgtttaaaattgaaggggaagattattttttgacgccgtccgttggcatcagcctgtttccggaagacggcgaagacggggaaacgttaatcaaacatgcggacacggctctttttaaagtgaaggaacgggggaaagggcatttccttttttacagcaaaaaaatggatgccgacttccataattatattttgatggaagcccatctccgccgcgccattgaaaaaaacgagctggccgtccattatcagccgcaagtgcagctcgatacgggcaaaattaaaagttttgaagccttgttgagatggcgcaacccgaaattcggtaatgtcccgcctttgaagttcattccgcttgcagaagaaacagggctgatcacttcaatcggcgcgtgggtgatcgatcacgtatgcgcgcaaattgcacagtggcggcaaaaagggtgggccggtttccgggtcgctgtgaatatatccccgaagcagtttcttgatcccggcctggccggacttatcggaagaacgcttgaaaaatacaagctgcctgcgtccgtgcttgaaattgaaattacggaaggcgcaatggaagataaaggccatattttaaaagtgcttagtagcctgaaagaaatggggctgacgatatcggtcgatgatttcggaaccgggtattcttctttgaactatcttaaaaaatttccggttgacattttaaaaattgaccagtcttttgtccgggaactggaaaacagccaaaaagatgcggccattacaaaaacgatcattcaccttgcccaccagctcgggcttgaagtcgtcgcggaaggggtcgaggaacaaggacaggtggagtttttgcaatcggcccgctgccagaaagcacaaggttacttcttcagccggcctgtccccgccgaagaagtggaaaagcagctgtttgtgtaaaatccgtccggttaaattgcaaaaacgtattttcttttcccctgactaatggtacattgtatggtatggtatagaaaaaagaatttcaccaagacggctctttctatcgttttcggtgccagccggaatccgggccgcatttttggacacggaaggagcgttcaaaatgagcgaaagaatggacatgatttttatcccggctgaggctggatatattaaagtttacgttttcggttttttgcgtgacagtgcctgggggcaggcgtatgcggaatataacggcctgacggttgtggtaaaaggctataaccgtaagaaaacgatcatccgggcattaacgaagctgcatgagtccttattaaaaataaaaaaagattcttagtttcatacgccctggaagcacttgggccggggcactgggatcgtttgcgacggtatccggcagcttgccgaatccgttgattttttatatataatgaatggctgttcattcatgaaaggggagaaggttgatgaaagaaaaagttgtcatcgtaacaggcggttcaagcggaatggggaaggcaatggcggccaaatttgcgcagtcagaagcaaaagtggtcattacaggaagggatgaggaaaaattaaaggcaacaaaagcggaactgctccgttaccattctgatattctcacggtgcaaatggatgtccggaatccggaagacgtccagcgaatggtggaagagacagacaaaaaattcggacgcattgatttccttgtcaataatgccgccggaaattttatctgcccggcggaaaaattatcggtaaacggctggaatgcggtcatcaatattgtcttaaacgggacattctattgttcacgggcggttggaaactactggatagaaaaaaagatcaaagggagcatcctcaatatggtcgccacctatgcctggggggcaggagccggcgttgtccattctgcagcggcaaaagcgggtgtgttatccttaacacgtacacttgcggtggaatggggcaaaaaatacggcatccgcgtcaatgcgatcgcgcccggcccgattgaaagaacaggcggtgcgggcaagctgtgggaatcggaagaagcggcaaaaaggacattagacagtgtcccgctcggacggctcggaacgccggaagaaattgccgaacttgcttttttcctgttctcgtcccatgctgcctatatcaatggagaagtgattacaatggacggcggccagtggctgaatcagcatcctttttaaacggccgcgaaaggagcggatcatgcagcaactgaaaaaagaacattttatcacccatttttcagcggaaaacaagccggcttacaaagtccggctgaacgaaacgtttgccgtggagacgtttgattgctacggcggaaaaatcacattggaaacccagcttaggacggaagtggacattccctttatcaacccggcgacaggcccgattgagattgaaggggttaaaaaaggcgacatcctttgtatcaacattcaaaatatcgagctggatgaagccggtgtcatggtgctttaccctgggatgggggtgctcggcgaggatgtaaaagaaaccgatacgcgcatcatccgtgtgaaagacggtcacatccagtttaacagccagcttcaatttccggctgccccgatgatcggcgttatcggcgttgccccggaaaaaggcgcggtgctttgtgaaacacccggggaccatggcggcaatatggatacgagatggatcacaacggggtcgacattgtaccttcccgttttccatgatggtgccctgcttgcgctcggcgatcttcacgccgcaatgggggacggggaactggacggttccggcgtggagattggcggaaaagtcaccctgcaatgcacgaaactggccggcgcgcccgctatcggcatgccggccgttgaaaccgaccgcgcatggtttttgatttcatcggcagaaaccgtggaagcggcgacgaaaaaagggatgcgagcggctgcaaacaggttccgggctgctttcgggcttgggtttaatgacgcctacaggctgttgagtgccacatgctccctagaaatcagtcagattgtaaatccgcttgtgacggtcagaatagctgtgccgaaagctgttttgcccgatttgttcgcgccgggccctctgctttaaaagcaggacactgaaaaagtattcaagaaacggtgagacactctggatgagcggtgtctcgccgtttttatgttttcttttcaattttttggagcggcttcttttaaaacaggagttttttctccgggacaaatcgcaaaaatgttacaaggtcttccccgatttcggataaaataaggacagaaacggcacaaaatgaaaaaatttgccgccgctcccttttctaagcgaaggttttactgtaaaattcgaatgggacaggttatcatttgtgtgaataaaagggtgaatgccggcatccaaaaccggtactcacgttcgttgaaaggagtccattatgtctcaattattaggtattatccaaagactgcaggcgatgcaggaagcaaaagatacaggggaagtccagcaacggcgttttgaagtgaacggcaaggcgctctgccaggtgaaatttttcccgcagaccggaacgtttgaactggaagtattcgatgggcaaaaacacgccagcaagtaccagtttgacgatctggatattgccgccatcgaaatctttgatatcgtccaggaaggctctgacagttaaaaaattttttcgcccggcacaaagccgggcgtttttctttcgtcaatcaagtcctgtttatgataaaatagtagtgatccatcatgcatcaacggcaaacgaaataagcatctcctcttgaaggtttttgtacctgaaaatacggaagaaaaggagatttttgcaagatgatttcattgcagagccaggaatttcttgaaccgaaaatcatggattttatgatcccgtctgaaaaagtggcccatgtgcaggttgggaacagcctggaacatgctttgctcgtgctgacgaaaagtgggtatgccgctgttccggttttggacgccagctaccgactgcacggcctgatcagttccgcgatgatcaccgattccattttggggttggaacggattgagtttgaaaaactaggcgagattaaggtggaacaggtcatgaaggcggacattccacggctgaatgtgcatgacaattttgaaaaagcgttgcgctggcttgttgaccacaattttttatgtgttgaagacgatgaaggattttttgccggcatttttacacggcgttcgcttctgaaggaattgaaccatcatattcataaattgaatcatttttagcggtggcaccgcgcaaatggctgcgcggtccttttttccataaaccaaagaaaacggattggggttaacatgaatttttcggagtgtcagttactgtctgttttagcacaggagttaaatatgcggaaggcggctgaacggctgtttgtgtcgcagcccgccttgtcgcaaaggctgcagtcgattgaaaagcagtggggagcgcaattgtttctccgcacgcaaaaagggttgatcataacgcctgaaggggaactggtcatccagctcgccaacgaaatgctcgaaagggaagaaaatgtgcgggaagccatccgcacgctcgactcaaaagtgtacggaacattaaaaatcgcctgcgccacgatcgtcggccaaaactggctgccgaaagtactgaaaacattcgttgaaaaatatccggaggcaaaaatctcgcttgttacgggctggagcagtgaaattttgcggtccatttacgaagatgaagtccatatcggcattgtccgcggcttgaatgaatggaaaagtacgaaaatccatttgtttgaagatccgctctttcttgtagaccaggaaattgacacccttgaaaagctgccggctgccgaccggccgtttatccagtttaaaagcgattcgaattattatcaggaaatgatggactggtggcaccgcgagtttcaaacttccccgaaacaaacaatcgtagtagaccagatcgaaacgtgcaagcaaatggtttttaacggtattggctatgcgattttgcctgcgatcacgctggacggggcggaaatccgccatctgcacaaaattccgctcgaaggggaaggcggggagccgctgaaacgcgacacatggctgctcggttatgacgccgcgtttcaattgaagcaggtccgcgcttttgtaaaagtggtgcgtgaatttattgcggcgcagccccatatcctttaaaatgaaacatatgcgcaaatgatcacatttacgtgcgaatctgctgtcaggaggcatacatatggacatgatggatgcaaatgaaatcatttcattcatagcaaacagcaaaaaatcaacacctgtaaaagtatatgtaaaaggaaatatcgaaggccttgatttcggtgaatcagcccgtgtttttgcaggcggcggcatggctgtcgtctttggtgaatgggaagagatttcggccgtgctggaagcaaatcgtggcaaaatcgcggattatgttgtggaaaatgaccgtcgcaactcggccattccgcttctcgatttaaaaggaatcaacgcccgcattgaacctggtgtcacgatccgtgaccgtgtggaaatcggcaataacgccgtcattatgatgggggccgtaatcaatattggcgccgtcattggagaaggcacgatgatcgacatgaacgccgttttaggcggccgtgcaacagtcgggaaaaactgccatatcggagcgggcgccgtgcttgccggggtcattgaaccgccttctgcgaacccggttgtcattgaggatgatgtattaatcggggcgaatgctgtgattctggaaggcgtacgcgtcggaaaaggggcggttgtggcagccggtgcggtcgtcacgcaagatgtgccgccgcataccgttgttgcgggcattccggcaaaagtgatcaaagaaattgacgaaaaaacaaaatccaaaaccgaaatcatgaaagacctcagaaatttgtaagccggggacgggtgccaaaaaaacggtgcccggccttttttgccataccggaaaggaaggactggatatggaaacgaatttgattgccatcaggcgggatctgcaccggattcccgaactcggatacaaggagcataaaacacagcggtacatccttgattttatttcgcgtttgccaaaaggccatcttgaagtgaaaacatggaaaaccggggtgcttgtaaaagtaaaggggacctgccccgaaaaaaagattggttaccggacggatatagacggcctgccgatcaaagaagagacagggttcccgtttcaatcggaacacgaaggaaacatgcatgcgtgcggtcacgattttcatatgacgattgcactcgggattttatcgcattttgcaagccggcccgttaaggatgatctgatctttatttttcagccggcagaagaagggcctggcggggcgaaagcgatgctggaagaagtgctgcacgatgaatggcggccggaccttgtgatggcgctccacgttgcgccggaatacccggccggtacggtggcggtaaaaaaggggctgctgtttgccaatacatctgaactgtatattgacctggaaggaaagggcgggcatgcggcctatccgcaacatacaaaggatatggtggtggcggcggcccatctggtgacccagctccagtccattatctcacgcaatatcgacccgctcgacagcgcagtggtgaccatcgggaaaatcaccggcggcacggttcaaaatgcaatcgcggaacatgcgcgccttgaagggacaatccgcacattatcaagtgaagcgatggaaaaagtgaagcacaggattgaagcgctcacaaacgggctttcggccggttttgagtgccgggcggaaattgattacggctgtaattattaccaggtgttcaatcatccggaagagaccgcccgctttatggattttgtccgaagctacggcggggcgcacctgcatgaatgcagggaggctttaacaggggaggatttcggctatatgttgaaagaaatccctggctttatgttctggctcggagtcgggtcaccatacgggctgcaccatgccaaatttgcgccggacgaacgtgcgctcgagacagctgccgatttgatggtagcctatattttatcgttgcaataaaaaagaaggggaactccccttcttttttattacggcgttattcttcttttttggaaaggcaatggtcgcattccagcatgtatgattctgcttgttcttcaatcggctgaccgcattcagggcattgtttcgcaggcaatgttttgaaaaattcaactgggctcatcatcatttttcatccatctcctttttcgtgtttggaattgtatcagctgttataaaaccattcaatgatgctgcgacagccgggcccgggctggtgtcagcaaaagtatgttttataacaacaaataatttatccttctgttataatacagtatataccctgaaatttgttttgtacagtattttttgcaaaaaaaaataaaaaattcttttcaaacgggtggataaaattggaaacgtttcctctgcaaaacgccgggcggatcgggtacaccggtttggcgcgcctttttcaaacagacatacaaaaaagcactatgctaacggggaggacactgaaaaaatgtgttttaaatttatttatacaatgcaaaaaaacggcgagacacgatgaatggtggtgtctcgccgtttttcgttttcttttggactttttaagcgggcttcctgacgggatccccttttttaaacttccataataatcggcataatcatcggccggcgtttcgttttttcgtataaaaacggcgccagcgtatccgtaatttcatttttgatttcggcccattgcgtcgttttccgttccatcactttattcaagtgctttgtgatgatcgtttgcgcttcgttaatcaaatcgccggattcacgcatgtacacaaaaccccttgaaatgatgtcagggccggatgcaattttaaactcgttcatattgatggccacaacgacaatgacgagcccttcttcagaaaggatgcggcggtcgcgcaaaacaatattgccgatatcgccaatgccgctcccgtcaatatagacagagccggatgggattttgccagcaacttctgcggtgtcatgaccgagcgccagcacttccccgttatccatgataaagcagttttcttccggaacgccacagtcgttggcaagcttggcatgcatcctgagcatccggtattcaccgtggattggcataaaatattttggcttgatcagccgcagcatcaatttctgttcttcctgaccgccatggcctgatgtgtgcacattgttcaaagacccgctgatcacatcggcgccggcgcggtacagcaaattaatcgtccggttgatgcttgtcgtattacccggaatcggggaggaagaaaaaacgacggtgtcgcccggttggatctggatctgccggtgcgtgccatttgcaattctggacagtgccgccatcggttcgccctgggtaccggtacaaagaatggtaacccggttggccggcagacggttcaattgttgtgtgtcaataaacgtatctttcggggcacggatatagccgagatcacggccaatttcaatcgccgcttccatactgcgcccgaacacggcaattttccgacccgccaaaacagccgcttccgtcatctgctgcaggcggtggatattggaggcaaaggttgcaaaaataatccgtccgtccactttccggaaaatatcctgaatgctttccccgacacgtcgttcagacatcgtaaaatgcggcacttcgctgtttgtgctgtcggacaaaaggcaaagcacgccttcttttccgatttcggccattttcgttaagttggccggctcacccactggggtaaagtcaaacttaaagtcgccggtgtgcacgatattgcccggcggcgttttgacgacgatgccgtaagaatccggaatgctgtgcgtcgtccggaaaaacgtaacagatgttttccggaatttaatcacatcgtcttctttaatttcaatcagctttgtctgccggagaaggccgtgctcttccagcttgttccggataaggccgagtgcaagcttcccgccgtaaatcgggacattgatctggcgcagcaaatacggaatgccgccgatatggtcttcatgcccgtgcgtaataaacaggcccttaattttgtccgcgtttttcacgaggtaggtataatccgggatgacatagtcgattccgagcagttcatcttccggaaatttgatgcctgcatcaattaaaatgatttcatcttgaaattgtacgccataagtattttttccgatttcgcctaatccgccgagggcgaaaaccgctgtctggtcatttttaacaaatttcatacagttactccgttaatttaaaattttcctgctgcttttcgtattcaagatattttccctcaagcagctgaatgtattcaatgttgattcggcggtctttcaacttttggcgtacttccctttccgatccggcttcaatatagaacgtcttcgtgttttcccggacaggaatctcttcaggattttcctggtaatacactttgtaaatcatgattaatctctccttgctccgttttcaatgtaactttttctattatatataaatcatggtacatatcacaactttttcatggcctttttttcataaagaaaagaataatccctctggaaaagagggattcaaaagttcaggcgattaactttttgcgcagcatatctttccactgttttaaaagcttcttcctcagcttttttaacattgtggatcaactccctacttctattgtaatatttatttggatattgtaaaggcgtgcggctcatcttgtcctttattatatgtagggaaaatgcggaaccatcacgccaaaatatgacaatttccggcatgccgggaaagattgctgcaaaaatggcagcgtttgcaacaacgtttcgggcccgcggaaccggttttcctgaaaaccttctctcgcaacgtttccgcttttatagtacagtttaaattgcatattgatacagttttcccggggagaatgattcggtatattaaaaaaatatcggatagaaaaagcgtttataattgacgcttttttatttttcatgtactctatatatgttgaatatagtgttgtattagtcacatccgcttttttattgatacagcgcttttttggcaggccaaaaatgattgcggttacttgaaagaattgtcggtttctgcagtaaacacacattttttaaaatcggcgaaattgtatatccatatatgcggataaagaaaggattggtgaacgggatggcttcacgcacaaaccttgatgaagtaaagacgcttcatgatattgaagaaaagtttgaaacagtccaaatcttaaatgaagaagggaaaattgtaaacgattccctcatgccggatttaacggatgaacagcttcaggaaatgatgcggagaatggtgtatacgcgcattcttgatcagcggtccatttccttgaaccgccaaggccgcctcgggttttacgcgccgactgccggccaggaagcttcccaaattgcttcccattttgcacttgaaaaagaggacttcattctcccgggataccgcgatgtgccgcagctgatctggcatggccttccgcttgaacaggcatttttatggtcgcgtggacatgtggacgggatgaagggcattgaaaaattgaacattctcccgccgcaaatcattatcggcgctcagtatgtgcagactgccggcgttgcgctcggcattaaaaaacgcggcaaaaaggccgttgccgtgacatatacaggggacggcggcagttcacaaggggacttttacgaaggcatcaactttgcgggtgcttttaaagccccagctgtttttattgttcaaaacaaccagttcgcgatttcaacgccgcgttccgtgcaaactgcggccaaaacactggcgcaaaaagcggtggctgcaggcatcccgggcattgtagtggacggcatggacccgtttagtgtatatgcggcggtaaaacgcgcgcgcgaacgggcgctcgccggagaaggtccttctctgattgaaacgatctgctaccgtttcggcccgcatacgatgagcggggacgacccgacgcgttatcgtacggaagaccttgacaatgaatgggcgaaaaaagatccgctcgtccgtttccgcaagttcctcgaacagaaaaacctgtggagcgaagagcaggaaaatgaaacgatcgaacaggcgaaagaagatattaaagctgccattaagaaagcggacagcgcacctaaacagaaagtgacggatctgatctccgtgatgtacgaagaacttccgcaaactttaaaggaacaatacgaattttaccaagcaaaggagtcgaaataagccatggcccaactaacgatgatacaggcaattacggatgcgctcaggaccgagttgaaaaatgatgaaaatgttttggtattcggtgaagacgtcggcgtaaacggcggcgtcttccgggcaacggaagggctgcaaaaagagttcggcaaagaccgcgtcatcgatacgccgctcgccgaatccggcatcaacgggcttgccatcgggcttgcgctccaagggttccggccggttcctgaaatccagtttttcggctttgtttttgaaacgatggactcgatccacggccagatggcgagataccggttccgcaccggcggggatttgaaaatgccgattacgatccgcgctcctttcggcggaggcgtgcatacgccggaaatgcatgcggacagcctcgaaggactcatggcgcaaacaccgggcattaaagttgtaattccgtccacgccttatgatgcgaaagggttgcttatctccgcgatccgggacaatgacccggtcgtttttctcgaacatatgaaactgtaccgttctttccgggaagaagtgccggaagaagaatatacgattccgctcggaaaagccgatgtaaaacgggaaggaaaagatatttcgattatcgcttacggcgcaatggtccatgaatcattgaaagcagcggatgaacttgaaaaagaagggtactccgcagaagtggttgatctccgtacagtcagcccgcttgatgtagaaacgattgtggcgtctgtggaaaaaacaaaccgcgccattgtcgtccaggaagcacagcgccaggctggtgttgcggcaaacgtcgttgcggaaataaatgaacgcgcgattttgagcctggaagcaccagtattgcgcgtaacagcgccggataccgtttatccgttctcgcaggcggaaggcgtttggattccgacctataaagatattttggaaaaagcaaaagagacattgacattctaaaccggtttttgccgtaaacgggtgatggcggcgcgttgaaccgagatacattccaatcaagttttttgctgcaccttgatgggggcgcattttgaaaaaaggagcgtgaacaccttgtcatttgaattcaggctgccggatatcggcgaagggatccacgaaggcgagattgtaaaatggtttattaaaccgggcgataaagtttcggaagatgatgtgctttgtgaagtgcaaaatgacaaatcggttgtcgaaattccgtcccctgtggaagggactgttgaagacattcttgttgaagaagggagcgtcgcagttgtcggcgacgtccttgtaaaattcgatgcgcccggatatgaaaatcttaaatttaaaggggatcatgggcaagatcagaaagaagaggcggcagaaagtgcaaaaccggaaccggccaaaccggaaccggcaaaacaggaaacagctgaaactgccaagcctgctgaaaaagaagcagaacatggctccgaatccgcggatcgccgcgtgatcgcaatgccatccgtacggaaatatgcccgggaaaaaggcgtcgatatccagcttgtgtccggaaccggaaaaaacggccgcgtgctccgcgaagatatcgatgcgtatgtgaacgggccgcagcagccggaagcggaagccggcaaaaccgaagcacaggcacctgcttcccagaatgctattcctgaaggggaattccctgaaacacgtgaaccgatgagcggcatccgcaaagtgattgcaaaagcgatggtcaactcgaaacaaaccgcgccgcatgtcacgctgatggatgatgtcgatgtgacggcacttgttgcgcaccggaaaaagttcaaagagatcgcggcggaaaaaggcatcaagctgactttcttgccgtatgtcgtaaaagcgctcgtcagcacactgcgggaatatccggttttaaatagttcgattgatgatgaaacgaatgaaatcatccataagcattattacaatatcgggattgccgccgatacggagcgcggcttgcttgtgccggtcgtcaaacacgccgaccgcaaaccggtatttgcagtgtcacaagaaattaatgaactggccgaaaaagcaagagatggaaagcttgccccgaacgaaatgaaaggcgcttccattacgatttccaatatcggttccgccggcgggcaatggtttacaccgattatcaaccgtccggaagtggctattttaggaatcggccgaattgcagaaaagccgatcgttaaaaacggtgaaattgttgcagcgcctgtactggcattgtcgctcagctttgaccaccgtatcgtcgatggtgccaccgcacaaaatgcgttaaatcatatcaaacgtttgttgcatgatccagaacttttattaatggaggcgtaatctgatggttgtaggagattttccaattgaaacggacacaattgtaatcggcgcagggcctggcggatatgtcgcggccatccgggcagcccagctcggccaaaaagtgacgatcgttgaaaagcagtttatcggcggggtttgcttaaatgtaggatgcattccttcaaaagcgctcatttcggcggcgcaccgctatgaatacgcaacggaatccgaggcgctcggcattgccgttgaaaatgcaaaaattgattttgggaaagtgcaggaatggaaatccggcgtcgtgaaaaaactgaccggaggcgtagaaagcctgttaaaaggcaacaaaattgacatcgtccgcggggaagcctattttgtcgatgaccatacgcttcgtgtaatggacgagaaatcagcgcaaacctatacatttaaaaatgcgattctcgcaaccggttcgcgaccgattgaaatcccttccttcaaattttcagaacgcgtcattgattcaaccggcgcgctgagtttgaaggaaattccggaaaaactcgtcattatcggcggcggcgtcatcggaatggaactcgggacagcctatgcaaaattcgggacgaaagtaacgattttggaaggggcaaaagacattatcggcggcgcgtttgaaaaacaaatgacttccctcgttgtccgcaagctgaaaaaacggggtgtcgaaattatcacggaagcgatggcaaaaggcgtggaagagaaggaaaacggcgtagttgtcacgtatgaagcaaaaggccaggaacaaaaagtggaaggcgattatgtgctggttacggtcgggcgccgtccaaacacagatgaactcggccttgaacagttgaatttaaagatgacagacaggggcattatcgaagtggataaacagtgccggacaagcgtgccgaatatttatgccatcggcgatattgtcccgggcccgcagcttgcccacaaagcctcctatgaagggaagattgcggccgaagccatttccgggcagccggccgaagtggattacctcggcattccggtcattgtcttttctgatccggaacttgcaacggtcggctatacagaacagcaggcaaaagaagagggcattgattatgcagtcggcaaatttccgtacggcgcgaacgggcgggcacttgcccttgaagccggcgaaggtttcgtcaaactgattacacgcaaagaagacgggctgttgatcggtggccaaatcgtcgggatcagcgcttccgatattatttcggaaatcggcctcgcaatcgaggcgggcatgacagcggaagatatcgcgctgacgatccatgcccacccgacattaggggaaattacgatggaagcggccgaagcggcactcggcaccccagtccatattttaaaataatgattcaaaggcttcacaccgggaaggctgccccggcgtgaagcctttttccgtttaaaggcgccgctataaggctataacagtaacaactgcatatgggacagattttttcgtgctggcaggcaaggttataacaacgaaactgcgtgcatattttgaattatgatgaaaggtgcaggtgggacaatgaaatgtacggtggcatttttattccagatcatgatatggagcggttttaaactggcagagtggttgtccgatcacgatccagttatttttaccgccgccctgttcattatttttttattcattgcctttgccctggcaaaatcaattgtgcattcgctccgggctgcatctgtggtaacggtgctgagtctcgctgtatacgggcttgtggaagtgtcattttcaaaactgattttctaaaacaaccgcaaaatgatttcgctttcaattgtataacataatttaaaatatgttatacaaaatccttgattttttctccagtatgacatattataatattacaagcgattacaaaaagcgcaaaggggaggaaaatcggatgggaatcattgtttgccaatcatgcgatgccacgattgaccacgttgaggaagaaaaagtatccgtgctttactcaacgtgtgaccaatgtaaacacgaagaagaatagtcctgaactgtagcacttgatttttccaatgcatgcgtccattttctctcggccggcttgttgcccggctttttttgcgtgatgggacaaaaaagcaggcgggaaggccccagcctgctttttcaaacttattgaatggcatgatgttctttaatgacgcggatcgtttgcaatgtttcgtcttcaggcccctgtacgggaaggccggcttcgatgtttttccggatataagcaatgttttcttccgtaataatttcccccgggataaaaatcggaatgcccggcggatagaccatgacaaactcggcaatgatcctgccagcagaaccggaaagcggaatggattccgtctcggcataaaaggcatcacgcggcgagagggcaagcgatggaatttcgggaagcatcactttcacccctaccttgccggacaaatgcgagaacgtgtcggacaagctgtgtaaagcctcaacgagcaagtccagctccgtttccgtatccccgggcgtcacaatgcaaagaatattgtacaaatcagagagttccacttctatatggtaggtttcacgcagccatttttccgcatcatggccggtgatccccaaatcttttacagagatgatcaacttcgccggatcgtaatcatatgttgctttcgtttggaggatctcgcttccggcgcaatacaaatgatcgatttcgtttatccgctcccgtgttttttgcgcaaggcgggttgtttccttgatgatcgtgcttccctcggttgcaagcctttttcgggcgacatcgagcgaagccagtaaaatgtaggaagtggacgtggtcgtcagcatgctgaaaatgctttggacacgttttttcgatacaagcccttccttcagattcaagatcgaactttgcgtcagcgagccgccaagcttgtggacgctcgttgcggccatatcggcgccggcctgcatggcggaaactggcagttcatcgtcaaaatgaatatggacaccgtgtgcctcgtccaccagtaccgggacatggcaggcatgggatatatccacaatgctattcaaatcagcggaaatgccgtaataggtcggattaatgaccagaacggctttcgcatcgggatgctgcttgagcgctttggaaacggacgccggggtaatgccgtgtgagatgccaagcaaaggatccacttctgggtggataaaaacgggcacggcgccggaaaacacaatcgcagacatcaccgatttatggacattgcgtggcacaataattttatcgcccggcccgcagacgctcatcaccatggccataatcgcgccgctcgtcccttgtacggaaaaaaacgtggcatccgcaccgaatgcttccgccgcaagcttctgcgcctcctcaatcatgccatggggctggtgaagatcatcgagcggctcgatattaattaaatccagttttaatacattgtcgccgatgaatttgcgaaaatcaggatccatcccgcgcccggttttatggccgggaatatggaattggacgggatttcgttcaatatgccggagaagcccggtgtataacggcgtgtgatattgtgacaatcattccacctctttatctcattgcttgcttttgaagaaaaacaagatgaattatagcattccggacacggtttttaaatagtttttctttgcacagggaaaaaaagccggatgcgggcaatggaaaaagataaagcgcataaagcatggagaaatgaggggaagctagacggtgaatgtacaaggcggggagccatgggaaaccaaacggatggtagcccttgtattccggcagatggcggcatcattggccaggcggaagcgattcaggtaaaatagaacgggtatacagaagaaaagcgaggtggtttggatggaatatccatatccgatttcagctgactggtcgacacaggaagtcatcgacgccgttcaatttttcgaagcggtggaagaagcatatgaaaaaggggtcaaccgggatgtgctgcttgccaggtaccgccgttttaaagaaatcgtccccgggaaggcggatgagcggaatatatgcaatgaatttgaagaggcgagcggttattccccgtaccgggccatcaagaaaatgaaggaagagcagggaccggtcattaaaatggataaaaacggatcgcgcgattagcggcacggaaagaaagcagcatcacccgctgatgctgcttttaaattgtctgcaaattacgaatcggcacaggagaaaaagcgcaccgtgttccggcgcgcttttttccactctgcatgctgtttaggccattttgtagatgggtaatacatgtacaaagacgtcctcgatcgttttggccagttcatccggggacatgccggctgcttcttcccgcgggatctcaagcccgcaaagcatttcggcttttttaacaacctgcatccgtctgaaaaacgtgtttaaagtatggggattcatacggtcagtgcggatgccacccggttttgtatgatcatccgaccaaatgtaatggccgggtatattttctaaaatcggatcaattttcttttcgagtttttttccgatggacgctttttgcgggcactcattcatgacggccgtgacaatgaagagccggtcttcccacagcccgatttgaaaatgaggaagcattttgtagccgcgcttgccaggggaaaaggccacccacgtatctttcggcggattgacggtacggcgggcgtgtttggcaacatgataaaatatttcttcaccggtcaaaaccgacaaaaccggcgaaaaatactcccccaatacttcaagtttcggacggacggttgatttcagctgttccatccgctgatcgaggccttcgatccggaaaacgtcaaaatcctgtccagtaaaagcagtgatgcccatttgttcacctccgttctgtatgaaccatggggatattcatattttatcatccatcagggaggtttaacaaataaaagccggtgggtaaaaataggtatacacacaattttgttacatcaatcgagattacacataatatatataaagataatatcagaaaattcatatcattaccccaggaggatgtgaagaaaaatgaaacaagtaatctcttcggtgaaaagaaaaccttatgaaagaaaacggattgcagtattgcgcatggaactggattacgaactggctacgttatatgaagcgatggaaatgaaagatgaagagcaaaaaggaaagtcgattaagcgtctggaaaaaatccgtgaagaactgctgaaaatgaaagccatgtaatggaacgaaaaggcaggatgtcgttgaaagcggactccctgtattggatacagatggggttcgtttttgtgcaggagaggttcatctttactgacaaaaccgctatgggaaaacgatttcggacgcattctcaaaacttgataattgtctttatttcctttacgcttaagggaaatgatttgcatagatggagggcccgactatggacagatgggaagaaatcaatacatatgccgtccggtggatcagggaagcgggcgagcggattcttgcttcgcaaaaaccgctgcaaattgaaacaaaatcggaccgcaatgatctggttaccaatattgacaaggaaacagaacaatttttaatcggcaaaatccggacaacctttccggatcaccacattttgggtgaagaaggcttcggtgaggatattcgtgatacagaaggcatcctctggattgtggatccgattgacgggacggtcaattttgtccaccaaaaagtcaatttcatgatttccattggggtctacgagaacggagaaggcaaactgggctatatttatgatgtcgtccggaaagaattgtattttgcagaaaagggcaagggggcttattttaacggggaacggattccgttacttgcgcaaaacaggctggaagatacgatccttgcgctgaatccgtattgcatggtggaaaacaggggtatcgacccggcccgtctggcagcgcttgtcagggatgtgcgcggcacaaggagttacgggtcggcagcgcttgagcttgcttatgtggcaatgggaaggcttgatgcttatattacgatgcgcctgtcgccgtgggattttgccgccgggaaagtgatcgtggaagaagtgggcggcgttgtgacggatgttttcgggcgcccgctcgatatgctcgggaacagttccgtgtttgccggcaagcccgggctgcatgaggaaattttaaagcggtatctaaaagggcaggaataagaaaagaggggctcacagtttcccctcttcacgcatttttttctttgttttaaagccgaatcccataatgacaatgagaagcgcggtgcaaccgagaatgccggcaacgctttgggcgccgatcgcaacgccgatgccgcacatggaaaggaatgcagccagtgaaaagaacacaaatacccatttgatttcccgcatatgatgaacctccctctccccttattttagcgaaaatgttttaataaagccagcattgtgttataatattttagttaaaggtacagactaacatagatttgcgtttaggcaggaggaaatgtttttgaaaagaagagaagatttacgcaacattgccattatcgcgcacgtagaccatgggaagacgacacttgtggaccagctgctgaagcagtccggtactttccgtgccaatgagcatgttgaagaacgtgcaatggattccaatgatctggaacgggaaagaggcattacgatccttgccaaaaatacggcagttcattataaagataagaaaatcaatattttggatactccgggacatgctgactttggcggcgaagtcgaacggattatgaaaatggtggacggggtcttgcttgtggtggatgcctatgaaggctgcatgccgcagacgcgtttcgtgctgaaaaaagcactggaacaaaacttgacgccgattgtggtcgtaaacaaaattgaccgcgattttgcacgccctgaagaagtggttgatgaagtgcttgaattatttattgagctggatgctaatgatgaacagctggaatttccggttgtgtatgcttccgccattaacgggacggcaagcctcgatccggatccggccaaacaggaagaaaatatgaaagtgctgtttgatacgattatcgaacatattccggcacctatcgacaaccgcgaagaaccgctccagttccaggttgccctgcttgattacaacgattatgtcgggcggatcggcatcggccgcattttccgcggaaaaatgcatgtcggccagcaggtggcattgatgaagctggacggcagcgtcaagcagttccgtgtcaccaaaatgttcggtttcttcgggctgaagcgggaagaaattgaggaagcatatgccggggatttaattgcggtatccggaatggaagacatcaatgtcggggaaacggtctgcccggttgaacaccaggaagcactgacgccgctccgcattgatgagccgactttgcaaatgactttccttgtcaacaacagcccgtttgccggccgtgaaggaaaatttgtgacggcgcggaaaattgaagaacggctccgttcgcagctgcagacggatgtcagcttgcgtgttgaaaacactgactctccggatgcatgggttgtatctggacggggggaactgcatttatccattttaattgaaaatatgcgccgtgaagggtttgaactgcaggtttcaaaaccgaaagtgatcattaaagaaatcgacggcgtcaaatgcgaaccggtggaacgtgtccaaatcgatacaccggaagaacacaccggtgcgattattgagtcgctcggttcccggaaaggcgaaatgctcgatatgatcaataacggaaatggacaagtccgcctgattttcaatgtcccggcccgcggattgatcggctatacgaccgaatttatgacgctcacgaggggttacggcattttaaaccatacgtttgattcctaccagccaatgcagtctggtcgtgtcggcggccgcagaaacggcgttctcgtctccatggaaacgggcaaagccacgacatacggcatgatgcaggtggaagaccgtggcacgctgtttgtcgagccaggcacggacatttatgaaggcatgatcgtcggggaaaactcccgtgaaaatgatattgctgtcaatattacgaaagcaaaacacgcgacaaacgtccgctcggcaacaaaagaccagacggcggtcatcaaaaagccgcgcataatgtcgttagaacaggcgctcgaatacctgaacgacgacgaatattgcgaagtgacgccagaatcaatccggctgcgcaaaaaaatcctgaataagagcgagcgcgaaaaagcgcagaaacgggcaaaagcagcagagaatgcataagcaaagaatagggccggcatgaccctgttctttcatatattcaaaggggaaaaggggagataggatgacaagcgaggcggttcaccaccaattgtcattttttgcggcgttgtacaaagtggatgaaaacccggaaccggggatgtgggccttgtatctgaccatcgtcgttctttcggtcattgtctaccggctcggatttgcgagaaagttgccagttctgaaatctgctgttatttatgtactgctccttttgggatgcacgctgctcacgttttttgccatctttttgcccgtgggggagtcgctctgtttagcggctgttgtgctcggcgtttacaaaatccgcctgtatcagcataaaaaaactgaaaaaaaggaacgttttccaatgtagcacgcttccggttccggaagcttttttttgtgccgcaaaagaactggacgcgcgcaatgattctaaccggacttgcccgtacatatactttagcagtgcctggtcctttgtccaatcccagcgatgaacaggtcacaccgcgctcacataaactaacataatccatatgaagcagggggcatcgatttgaagaaaatatacgtcttggataccaatgtattgctccaggatccatatgccatcttttcttttgaagataatgaaattgtcataccggctgttgtactggaagaagtggattctaaaaaacgaaatatggacgaaatcggcagaaatgcgcgccaggtatccaaattaatggacggtttccggcaagccggaaaactgcatgagaaaatcccgcttgaaaacgggggtgtgctcagaattgagctgaatcaccgctcctttcaccagctgcaggatattttcgtggaaaaaacaaatgacaaccggatcctcgcggttgcgaaaaatttatcgctggaagaagagagaaaagaaaatggccgcccggtgattcttgtcagcaaagatgcgctcgtccgggtaaaagcggacgcgctcggcctgttggcggaagattttttaaacgaccgtgtcgtaagcctcgatcatctttataccgggcaaatggaaatgtatatcagccccgatttattgaaacggttttatgaaaagcaggaactgtcgctgagcgaaattgccaaccacccgttctacccgaaccaatttctgattttgaaagatgcgctcggcagctcggcttccgcaattgccattgtggatcaggctggaaaaacggcgaaaaagctctttcatgtgcaggatgctgtctggggaattaagccgagaaacgcccagcagtggatggcaatggaacttttgctgcgccccgatattccgctcgtcaccctgaccggaaaagcgggaacgggcaaaacattgcttgcccttgctgcaggcctgatgcagacggaagatttgcatgattataaaaagcttttggtcgctcgtccgattgttccgtttggcaaagatatcggctatttgccgggagaaaaagaggaaaagctgcggccgtggatgcagcccatctacgataatcttgagtttttgtttaatacgaaaaaagcgggagaaattgatggcatattgtccggcatgagttcgattgaggtggaggcgctgacgtatatccgcgggcgcagcatcccggagcaatatatcattattgatgaggcgcaaaatttatccaagcatgaagtgaagacgattttaacaagggtaggggaacagagtaagatcgtgttaatgggggatccggaacaaattgaccacccgtatttggatgcttacaataacgggctgacgtacgtcgttgagaaatttaaagatgtgccgctcgccgggcatgtgcagctgcttaagggcgagcgctcaaaactcgcgcaaatcgcggcagaccttttgtaagaccactatatgaaaaaaccgggagcagctgtcttaaaacgtttatgctgcccccggcatccgggattattcaatgcgcataccggttacatatttgaccgggttttcccggtttgaaccgtcatccaataaaatgtgaagcgggccgtcttctttcagcgcccttcctttaatagaaaaggcagcaattaaatggccagccatttcaagcggataagcgacaggcccgttctttgtttcaaacacgattttttccgcatcttccagcggctccgcattttgaatgaacaggccgaccgggatgccaaatgtcccagttttcaaatggtgccgtttaaacttcggctttgtccttacagcagcctgcggatcggccccctctgccatggctttatcaaaatatttcccagttttctttaagtaggcttcttcctggctggtttcctgcttttcttcgtcgaaatatgtatcaagatcgactttccggtcatcaaatatccaagtgccgatatctagcgtaatcggaaacttcacttttccctttatttgcataatcatcattgtggcccctttctgtccgtctatacagcattatacctttcacggctgcccgtgtcacttgaaagcgtataaaaacagtccggaaagcgttcggggtcggggaattgcggaatttcaaattctgtctcccccgcttgtttacgggattccgggcgtttattgatttcgtataacttgcaaaatcacggttttaaaggtacaatttttattagattgatatgtgaacggggggatcaatttggcgtctgaaacaaaggtgaaccaccgggagaaagcatacagcctgctcaaggcggacgcagaaaagatattaaaattaattcaggttcaaatggataacttaacgatgccccaatgccctttatacgaggaagtattggatacacaaatgtttggtttatcccgtgaaatagattttgcggtccggctcggcttagtggatgccggtgacggaaagcggcttcttgattcgcttgaacaggaactgtcccttttgcatgatgcatatataaaaaaataatgttgaaaactcaaacgatgttccggttgtttgagttttttattttttgaataagggtcaggtaatggcggccggcgaaaaagatgttataatttaaaaataacggcaggagtttttttaaaacggtagaatattttttatcatgaatgttgcagtttttacggattggaaggttcctatgctgaaaaaaatcttaaaatcattcgactactcggtcatcgttgtctacctgcttctttgcttattcggtttggtaatgatttacagttccagcatggtgattgcagtgcagcgttacgggctggacagcgcctatttttacaacaagcagaaaatcaatttggcccttgcactccttgcgtttaccgttacggcttttctcccgtataaactatacgcgagcaaaaaattccttgcagtgctgatgtgcgggtcgatgttcgggcttttggcactgtttattttcggccatacgtcgaataacgcgcaaagctggttccggctcggttccagttccgtacagccgtcggaatttgtgaaagttgcgattattatttatctgtccgccgtttatgccaagaaacaggcatacattgacatctttaacaaaggggttgtcccgccgcttatctttcttatcgttgtttgtttcctggttgcgatccagccggatatcgggacggcgaccatcatttttgggattggctgcacgatcatcgttgcatccggcatgcgcctgaaaaccatgctgaagctggcagggctcgggcttctattttccgttctgttgtcgccgtttctttttctggaaaaggacaaaatctttacaccggttaagatcgcacggtttacaggctatttgaatccttttcagaacgaaggcggggaaggtcttcagctcgtaaactcctatattgcgatcgggtcaggcgggctgaaagggcagggactcggggaaagcattcaaaagctcggttatcttccagagccccacaccgactttattatggccattattgccgaagaacttggggcttttggcgttttgtttgtgatcggcgggctttgctacattgtgctgcgcggcatatatatcggcatccattcaaaagaccagttcgggagcctgcttgcgatcggaatttccggcatgattgccatccagacatttatcaatctgggcggcgtctgcggcctgattccaattacgggggtgacgctgccgtttatcagttacggcggttcatcgcttctgattttgtccctttccctcggcattctggtcaatgtgggcatgtttacaaagtatgaggaaaagtataaacacaaacaggaaaagccgcaggaagcgggcggagcaaaccggaggccgtatcaggtctactcaaggccgtaacgtttaaaaacgggtgcgcggcagagtgaaagcagaggataaaataaaaaggcgcaaggttttatgccttgcgccttttccgcctatcttacgtaagccctttgctgccttattttgcaccaagccgcaacatgcggtaccattggtttttccaaactcagcgaacccgggctttttttagcgggaggctgtctttgcttttggcaaactgcttcactcgcccgacaacaaggttcaaataacataacaggccgaacagacaggaaatgaaaaatgcgtgcaggagggtgaaagtaagattcatcctcgaaaaaacgaccatggcgcctgaaacagcctgcaggcagacaagcacgaacgcaatgatccatccccagtaaataacgcgctggttttgataatgccttaccgctttaaaggtgatataagcaatccagacaaagatgaggagtgccgccgtccggtgccccatctgcacccattcgaaccggtttgcgggcaaggaagggtcgctgttcacacaaagcgggaaatcccggcaaacaaggcttgcattcatatggcggacaagcgcgcccgtataaacgacgataaagctgtaaacggtcacgccgatcgtatgccatctcatgcttttttcaaggacaagcctgcctgcgtcaaatttctggtcccattcaaaaaccatcagcgttagcatcagcacggacgcaaacgaaatgagcgaaacgccgaaatgaagtgccatcacaagatcggatgaaccccagacgactgccgccataccgagaaatgcctgcagaagcagaaaaatgacggaaataatggataaaaatttcgtttctcttttatggccgattgcaaaccatgaccaaatggcaagcgcaaagacaagaaacgatgcgatgcccgtgcaaaacctgtgcagccactcaatcagcgactcgacagtgagcggatcaggaaaaattttgccgttacaaagcggccattggcggccgcagccaaggcttgaaccggtattggtgacaagtgccccgccaattaacaccaccatcatcgataaagttgtcactactccgagccattttaaagttgtgcgcaattgttccaccttcttttatctcatttgtaaacatgtatcacaagccacgaatgcaacatacagtcccgcatcattgcaaccgttcatatagtagaaaatccgttcggcaaggtgcttccaactatcatcttatcgtaaaacagtctgaaggaaaaatatttatttcccatgacacaaatttgccataaaaatgtgtcgaaaatatcacaccttcgcggtaatttatgattaaatataatataggcaggtatatttcggaattccgcatatttacatgttgggaaacttataaatgatcttagtatgacgatatcgttacatacagttttgattaatagccaaaaaggaaaagatggattatagttgtagtataccgttttccttattggcagcgtaaaaacatttacaaaaggaatccgccgacaacgtgtcaggccattttttttgaacggttttgaaaaattggaaggagggactatcgtggcagatagtcggacgatggatacaacaacaagggtaaaagctgcagacgcctctgcgttgaaagatttcttatccttgattaaaattggaattgtaaactcaaatttaattacggcatttaccggaatgtggcttgcattggaactgacaaacaggcattttttgcagtcgctggacattatggtccttgcgatggcgggaactgcgctgattgtcgccgggtcgtgcagcctgaacaactggtatgaccgggatattgatgtcattatgaaaagcaaaaattttaggccgacggttacaggcagattttcaaacgcgaaagtgcttacaattggcctcggatttgtggcaatcggcacactgctattgtttatgaccactccaatggcggggctgatcggactgtttggcgtattcagctatgtcgtgctgtatacaatgtggtcaaaacgaacccttgtcagcaataccgtgatcggcagttttgccggcgctgttcccccgctgatcggctgggcggctgttgacccgcatctcgggattgtgccatggatgctgtttttgcttatgtttatctggcaaccaccgcatttttatgcgattgcgatgaaaaaatgcgaagaatacaaggcagcgggcattccgatgcttccggctgtcaaggggtttcaaatcacaaaatggcatatgctcatatgggtggcattgcttattccggtgccgtttttcctgaaaccgctcggcattggttttatcatccttgcgacattgtttaatctgggctggctggcattaagcctgtccggttttaaaatgaagaatgatttaaaatgggcgaaatggatgttcatttattcgctgaactatttaacgatcttgtttgtagcaatggtaatcgctacgcttttctaaagggagttctttcttgcaaaagaaatccaatagattgcatccttgttctgacagaaagatacaggaaagaggggattggtagagcgatgaaacagcggctgcaaaaggggagtttgctttttattgtcactttgtttatggccgcgctttcgggctgtggtaagccatatttgtcggcacttgatcctgccggcgaagtggcccggaagcagtatgatttgatgatgtggagcgtttggattatggtgttcgtcatggttgtcgtattcgccgttttccttaccgttctcatacggttcaggcggaaaaaaggggacgaatccattccaaaacaggtgccggggaatcataagcttgaaatcttatggaccattattccgattgttttattgattttaattgccattccgaccatcagccaggtcttcagcctcggagatacgaaagcgatggataagaaaaaggatgccaagcaaggggcgcttatcgttaaagttcgcgccagcctttattggtgggaatttgaatacccgggttacggtgtggtgacaagccaggaactcgttgtcccaacaaaccagaaagtctacttccaagttaaagcctcagatgtgaaacactcattttggataccgtccgttggcgggaaaatggatgccaacacagataatatcaacaagttctggcttgaaattgatgatcagaaggcagaggatgccggaaatgtgttttatggaaaatgcgccgaattatgcggcccttcccatgccttaatggacttccgcgtgaaagcggtgccacaggatgagtttaaggcgtggatcagcaatatgaaaaatgcaaaagaaacaaaaccggcgtccgctctcgcacaggaagggcaggatgtattcaaaaaaagctgcatcagctgccacgcggtcacgccgaatgatacacggccggaacaggcacggacagctcccaatctggcaacctttggcgaaagggaaaaagtcgccggcattttggatcatgatgaggccaatctcaaaaactggataaaagatccggagaaatacaaaccggggacaaaaatgccagccttcggggataagctttccgaccggcaaatcgatgcgcttgcggcttatttgatgcaattgaaagctggtgaataaaacaaaggggatattcgaaagcaaaggggaggttaaagtgagcgtaggaacaaaaaaggcaggttttggcgccactgtctatgaatatctcacaacagtggatcataaaaaaatcggcattttgtatttgattacagggggattgttttttgtcatcggcgggattgaagcgctgatgatccgcatacagctggcggtgccgaacaatcattttgtcggcgcggatacgtacaatcaagtcatgacaatgcacggcacgaccatgatctttcttgcggccatgccgctcttgtttggttttatgaatgcgattgtcccgcttcagatcggtgcccgtgatgtggcttttccgtttttaaatgcattggggttctggttgtttttctttggcggtattttcttgaatttatcctggtttcttgggggcgcgcccgatgcggggtggacttcctatgcttcactgtccctcgcatctggcggacacgggattgatttttattcactcgggttgcaagtttcaggtttcggtacgctcattgctggggtgaatttccttgtgacgattatgaacatgcgggcgccgggaatgacgtacatgcgcatgccgatgttcacatggacgactttcgttgtgtccgcccttattctgtttgcgtttccaccacttacagccggtttgttcttgctaacatttgatcggatgttcggtgcgaaattttttgacgtggccttcggaggaaataccatcatttgggaacatcttttctggattttcgggcatccggaagtctacattttaattttgccggcatttggcattttctctgaaatttttgcacatttttctaaaaagcgattattcggatactcttccatggtattcgccgttattttaattgggtttttaggctttatggtgtgggcccaccatatgtttacaaccggcctgggcaatgtagccaacgccatttttgccgtgtctacaatgaccattgcggtgccgacgggcattaaaattttcaactggctgcttacgatgtggggcgggagcatccggtttacaacgccgatgctttatgcggctgctttcatcccgtcctttacattgggcggtgttaccggggtgatgctcgcggctgcacctgctgactaccaatatcatgacagctattttgttgtagcccacttccactatgttattgtcggcggtgttgttttcgggttgcttgcggcactgcattattactggccgaaaatgttcggcacgatgctgaatgagacaatggggaaaatcacattctggctatttttcattggtttccatttaacctttatgatccagcactggctcggattgctcgggatgccgagaaggcagtggacatatctgccgaatcaaggctgggatacggataacctcgtcagttcatccggcgcggtgttgatggcggcaggtgtgctaatcctcgtggccaatattgttgtcacggccgtccagaaccggaaagtcggaaacgatccgtgggagtttggcaggacgctcgaatggtcgatttcctctccgccgccggaatacaactttgcacaaacaccgcttgtcagaggaattgacacctggtggctcgaaaaaatggaagggaaaaaacaggtgacaccagcagagccgatcaaagacatccatatgccgaactcgtccatcttgccgttttttatggcattcggtttatttattgccgcgttcggcgcaatgtatcatgcaaaccataccaaagccggcatcacgatccttgtcatcggcttggcgattacccttggatcgatgctgatccggtcggtaaaagatgatacgggataccatattaggaaggaagccttaatggaacgcgaagaaaggggggccggggcataatggaaatagaacaaaattttacggcgaaaacatggccagagtccccggagcgggcgacgcttgaaggcaggaataaatttctcggtttttggctgtttttaggcggcgagacggtcctttttgcttccttgtttgcaacctacctggcgctgaaagacaagggcccggcatcaatggtgcatgcaaaagacttatttgaactgccgctaacctttttggccacggtttttctgttaacgagttccattacaagtgtgtatgccatttatcatatgaaaaattttgcttttaaaaaaatgcaggcctggtttttgattaccgttttgcttggtgcttgttttcttgggcttgaagtctatgaattccatcattatgtgacggaataccatcatacatttacaagcagcgcattcggttccgcgttttatacgcttgtcgggttccacggcggccacgtggcgttcgggctgttatggattacgacactgatggtgcggaacgcgaaacggggattgaatttgtacaatgcgccgaaattttacgtggcaagcctgtattggcactttattgatgtcgtctgggtgtttatctttacggttgtatatttgatggggatggtgggataagatggaacacaatgcacaaatggacagacgccatgttgaatacgaatacaggcgccgcaaaagcgcggaggaaatgaagtaccaggtcgtcagttttattttgatgatgtttttgactattgttgcattctgggccgtccatgcccatttgtccaaatggtttaccattccggttatcctgcttttggctgcgatccaggtcgtatttcagctgttttatttcatgcatatgaaccataagcaccatgaaggcccgaaacttttcatctttggcggcacactcgtcgcatttgtcacagtactggcattcctcaccatcatctggtggtgaaaagaaaagcggagggcgtttgcccgtcggcgtatgaatttcatagtccccgaactgagataaaggaaacacggcgaggaacgagccgatgttgacttatcgtaggggaggggactggaaattcactagccgacagcgcccggagctagacaaagaaaagcggaggcgactgcttagccccgacaggcgaatgttccggccgggatgaagccttggcttcaggacggacgggttattcgacccgaggggctaggagccgcagctagacaaagaaaagcggagggcgtttgattatcggctgctaggagccagagctaaaagtaaagcggagggcgcttcttgggcgcccccgctttaaatcgatttgcaatggtgcggaaaggagtggtaatggtgccgcttgaaatattcggatttcgtgcactgtggagcccttatttttttatcacgatcttactgtttgtttttctttattttctgcttgcgtccttatgcaaaaggtcttatttgaacgcaatgccgccgagtccggtgcagtctgtttctttttgtacagcgatggtattgctttacatcgtcaaaggctctcctgtcgatcttatcgggcatatcctgttttccgtccatatgctgcaaatgtctatcctttttttcattgtcgcaccgctgtttttgcgtgggatgccggtgtggatattggaaaaggggatgcagcttccggttgtcgcgcccgttgtccggttctttacaaatccggtgcttgccgttatcacctttaatatcattttttccctgtaccacattccggccgttttcgatcaggtcaaggtcactccttttctccacagcatctacaccattgtgctgtttcttttagccatagcgatgtggtggccgattttgtcgccattgcccgggcaatatgcgctgagtggcctgaaaaaaatcgcttatttatttgcaagcgccatgcttttaacccctgcatgcgccttaatcatgttcgccaatcatccggtttacaggagcttttccgacggaacgatgtggctttcgtccatgcatttatgtgtgcctgctgacatgctctccggagtggcgcgttacggctccccggcgcttttctcaccgcttcctgtactgcaggaccagcagcttggcggtgtggtgatgaaaatcatgcaggaaatcgtctacggcatcatgcttgcccgcatctttttccaatgggcaaggacagaacaggaagatggcagcacggaaaagaatccggttgccggagaacagcggaggctgatcgaacagcattaaaaaaggccgctctctatggcccgccgttttaaggggccacaggagcggcgcattttattcagcaaatacaaccaagtcttctttaagcgcttccaaaatttttctgcaatacatgacgagatcatgcggaaaatactcgtcatcgccgtactccacaccatgcggataataatattttcctaaaataggcgcctttaactgaatcacggcatcaaacgaatccacatccccctcggttgcaactccctgcacgcgaagataataggtgccttcttgaatcgtaaattttctatcatatgtgacgcgttcataatcccattgcccggcacgtaccatcttgtgccgctccattacatcatccaaccgcgtcagatccactttcatattttccaaacccgtgtcatcaaaccgcaaaaatacccctcccgtccgcacaattaaaatctttcaattttatcttatctgaatacaaacatttatgcaatgcaaatgtttataaccgcaaaaaaaccggccgcaccggctgtccttcgaggaggtgattgaaaaaattggtgcttttctgcttaaaactgtaaaatatataataaaatgaattaaaggagaaaaaatttacggaacatcaagagaggtgaagtcacctgcgtacctttttaaaaacagccgcgatccttgtgatcatatttctgatcggactttatgtccagcttcgtcctgaaaacggcgtactgcaaaaccattcctctaacaagaaaatggataacagttctgacattcatgaccacagcaaggatcaaacgtacagccgtccggatcatggcatgtcggtatatatcgggaaacctgtgaaaacgttgaccacacatttcggaaaaccacaaagggtggatctgtctccatatggttatgattggtggatttataagaaaaaatcgaccggttattttcaggccggcgtgaaaaatggcaaggttacgaccatttacgctgtcggaacccgtttagacgtagccccgtttgagattggagaaaatgtagaaaaaatttacagttccattttaatggatacggatatgacggtgcaaacaaatgaaggcacataccgctttgaattgtcggaagaagatttgaatatccgcccgcttgtccgtcttggggatatctatgcccagctggcgcttgataagttcagcggcaaattgctgtttatccgttttatggataaaaacacactgacgatgctgcatccatatgaaatggtgtaccacggagaactgcccgaatccgttccggaggatgatccgaaatgggttgacgtagaaaaggcgaacgccaggcaaatttttgaccttacaaacattgtcagggcacgattcggtttaaaaaaactggcctggaatacagctctttccgaagtggcgtacaatcacagcaaagacatggctgacgaccattatttttcgcatgtctcccccaaatatggagacttaaaagaaagattaaagaatgggcatgtttcttatgctgcggctggggaaaatattgccgcccactatacggatggtccggctgctgtggagggatggcttaattcagaaggccaccggaaaacattgctggagaaagatttcacccatcttggcgtcggggtgtaccagaaatactatacccaggatttcatgaaggcaccatagccggataccgttccagcctaagctggagaggggtccggctgatgtatgcatataaggcaggcgggctgcccggggcttttgaaagggtatttccggcttctcatttcaaaatgaaaaaagaacccgtgcaatgggcgatctttgtcccgtcatcccgaaaggcagttccttccagcaccatcgtttgcgtgccgcggtggattacctttgccttcgcttttaagcggcttcccgtccccggggcaatataatgaatggtgagattggatgtaacagcctgctgacccgccggcaacaggcgatttgccatcacgcccattgctgtatcaagcagggttgccgttacaccgccgtgaacgatggaaaagttattgtagagtaacggcgtaactggaatggtcacctcgcattcttccccatcgaagtccgcttccatcaaaaagagatccttgaaatatgtacgttcgttcccggcttgtttattggaaagtccatttaacatttgctgcaatacgattaagtcttcttccgttgccgcttggaccactttttcaaaagtatggtgtatttcttctttcatctcctgatacctcttttaacgcgtttttttaaaagcatacccatatcgtatcaaaattcacgggaaatgaaaaccttcacacctgcttactgccggcatatgctggatatgaggaaggtatgtgaacgtaacagaaagccaacgttcgaaaaaaatgttttctcgcggggtgagcggaaatgggaacgaaaaaattgcatccttccgtagaaaagtttaaagcttttacaaaaacccatcctttgattttaaaagaagtccggggcggaaaaaagtctttacaggatttctttgaagaatggtatatactgggcgaagacgacccggtctgggaaaaatacgcggcagaaggcagtgaaacgaaggaaaaaacgggcgggagaagcagctggctgaaccagctcggcgcgatgctcgagaacctggacccagcacaggtccaaggccacctgcagcatttgacggaagcgattaccgccgtccaaaatgtgatcacgcagtttacaggggggcagacgccacaatcccaggctccccagccgaagggcccgttttcattcagaaaagactagagaggggctgcacatatgcggaacgaagtaatggaagtcatccggcagtcgaacgaatggaaaacttttttaagggagcagccggcgtggtaccggaaattgtcaaggcatcccgaggaactggagcaatttcaaattgccgcgctccattattaccagaaaacgatcccgcagcgggttgaaaagtttgcaaacgggttgcaaatggcacaaatgatgatgcatatggtgcagtccatctatgaacaaggatgatttccgaaaaaatttgccttttttgagtaaatcagcgctttcttgcggaaaataaccgcaaggagtgatcgaaatgaagatggctgcaggattccttgctgtatgtttgctgtttgccggctgcagcgggcatatgccgcgtaaagagcagcgggaagcggatgctgcttccgcggcagaaaaccaggcatcagtccggtattttgtaaaagatcgggatttgttcgtggaatgtatgattccaagcgtcaccttttcaggcagccggcatgccaaaccggcaaaaatcaaagtctatgtggatggtgtatggaaaggcgagtacaatacggctgcatttgttgtaaaagggcttgataaaggggtacatacagtgcagctggaagtagtggacaaaaacacaggcgcccgcctaggcattcacaggcagttttatatttctgtcagctgatcgggcaaattcgcaaagcttgcggaaacatggtaaaatcatcatgtggaggtgagctttttgcttgcaacattggaaagcgcggaaattttgtctgaagctgaagcactggcgaaaatggtcattgcctcggatattgccgaaaattaccgggactgctataacaggatgtatcatgatccagccacacagcagaaaatccggaaatttgcacgcctgaaagaacagtttgaggaagtccagcgctttggcaggtatcaccctgattataaacgcatcaacaaagaaacaagggaagccaagagggaaatggatctggatgagaacgtcgcaagattcaggcgggcggaaaatgccctccaggatctgctcgaccaaatcagcctgatgattggcaaatctgtttctgaacatataaaagtgccgaccggaaatccgttttttgatgcctcttgttccggcggctgcggaaccggcggcagctgcagctgttccgcataaatcgtgataaggccgcaatccgcggcctttccttattgttccgtgaaaaaaggtatggtacactcattaaaaaaagcacgaaggggaaacgctatgttatcagatcggcagggcctcatcatttggctgtatcagatgaagcatacgaaacatttacgaagatttggcaatgtccattatgcgtcaaaaaggatgaagtatgccgtcctttattgtgaccgcaaagagatagagcaggtaaaagcgaaaattgaaaatcttccgtttgtaaggaaagtggattattccatgaagccgtttttaaaaacggaatatgaaaacgcaaaaccggacaaagcaaaagaatacgattataaaatagggctataaaggcgccgggtttgcatgctagcatttcctgcgtgtgcatcaccgcaaatccgccgtgcccaaaaaagcgttgctgcccggaagctccgtcccgcgcattttaaatcaagcacatccggctgcactctggccgaaatatttattgcagcggcggaatcagccggttcattcttaatatgccgattaaatattgataaaaaaggtttttgtcggaaaaagacgaagatggccggacttcgagttccacaatgtccgctcctaaagcagctgcggtttcggcaaacaggctgtaccgtttgtttggctgcaccctcggatccggaatcccttcaaggcaaacgtataacgcctgaaattcccccggatcggtcggttttaaaatgagcacgggcgaagtgacagcttgatccgcaacgatggtatgaagggcaagcatgccgtgcagccggtgccggtttgcttttgccagttcgatcagttcaaataaatctgtatatccgtttcctagttcaataaatctttgttgcatcttcattcctcgcttacaaacaaatttgctgcttctattctactgcacttctttttattcggaaagtatttctgcaaaataaaccgggggagatgccggccggctttttgaaacgacgtgcccggccaagaatgcggaaaataaaaaaccctgcagccaatactgcagggcccttctatatccttattccggacagaaggcaaagggagaggagaaaccggaggaagaacttatggggaaacgtaagtcttctccgcggttggcagcaacatcttttgatgctgctggtatcattatggccaacttttcctgaattatacttttgctttaaattttggtgaaaaacttttccacccggccggaaaatatggtaggataagatggaaatctgatgatacgtggtgaccagcatgagagtcatttcaggcagccaaaagggcactgttttaaaagccgttccgggaatgggaacgaggcctacgacagataaagtaaaagaagcgatttttaatatgatcggcccgtattttgaaaaaggcctgggcctcgatttatatgcagggagcggcgggctcgggatcgaagccttgagcaggggtatggagaaagtgattttcgttgataaggagatccaggcgctgcaaaccgtccgggccaacctggaaaaatgcgaatttttaggccggagtgaagtataccggaacgatgccggccgtgcattgaaagtgctggcgaaacgggggcttgcctttgatacggtatttctcgacccgccttacaaaaagcaaaaactaaccgcgatgctgaaatttatctcggcaaacggccttctccgtgaaaacggttacgctgtttgcgagcacgacgccggactgaccttaccggaaaaagcgggcaatctttttacatataaaacagcacagtacggcatcaccggcatcacgatttacacgaaaaagggggatgaaacccgtggggaagaccgcgatctgcccgggcagctttgatccgattacaaacgggcatctggatattattaaaagaggggcaaaagtatttgacaaagtctatgtggcagtgctgaacaatatttcaaaacaaccgcttttcgatattgaagaaagaaaagcgttgatccgggaagtgacaaaagacatcccgaatgtggaagtcgattctttccaggggcttttaatggaatatgcagaatcaaaaaaagcggatgtgattatccggggcttacgggctgtttcggattttgaatatgaattgcagctgacatccatgaaccgtgtgctgaatgatagaattgaaaccttttttatcatgacaaacaaccagtattcttttctcagctcaagcattgtgaaagaaatcgccaaataccacggcaatattgcggaactggtaccaccggttgtgcatgaggcattgaaaaagaaatttcaggggcaatagaaaagcgggcggaaccggacattccggaagagctggacgaacacagaagtgttgatacaatagaaaaagcaatgggaaccggacataccggccgtacataaagtgccggaaaatcccgggctgggccggatgtacattttaaaccggctccccaaaaccggacatgccgtttatacaccgcactaaaaactttaaaaacaggcccagtttatttattgaaaaatttgcaaaggcatcagaaaaagcgggaatgctccccgcttttttgcgcttttttcaggcccggtctgcccggcacgatcggtaataaaggaaaatgtacagcacaagacaggacagggtaaataacggcccgtaaattccaagccaatccgtgacgcgcgcgtacaagctgcggcctccacctggcataccaaaagcttcctgccacgcgcttttttcagcaaaaaagcgtaagtagaccggattccaaacgagccggatgatcacagccgacagaaaaccgtgcagcaggcgggcaagaaaaaacggccggaaacggatatctgtctgggcaagaatactggccacctgcgcctggatgctgaacccgccaaacccgaggatgaagctcgcggcgatgacctgctgaagcagcgaggattcctgcacttcactgatcatttggattccgagtgttacttcgaaaaggccagaaatgagcgggatgctcagcttttccgaaaaatgcgcaaggtgaagcagctgggagacaagcatgccgaatacggatgtgacatgcatatacagaagcaatttattaaagactgaaaacaggatgataaatccgccgatcatcagaagcgtctggatggcggacatgacagcgtccccgagcagcttcccgatcggcttgctgtttttaattcttgtcgcatgcaaaacgagaagcgcttcttttaaaagaaaggtatgtttcttttttggccctcttatatcctcgccggttccgtaaaaacgcatcaccaggccgacaataatattgcccgcataatgcgccgcggcaaacagaatgccgagagaaggattatggaaaaagccgacagcgaccgccccgaaaataaaaagagggctggaagaactggtgaacgctacaagccgttctgcttcaacccggtcaatctgtttttcctgacggagacgggcggtcagtttcgcccctgaaggattgccggaagcaagccccatggcccaagtaaatccgccaacacctggaacacggaacaatggccgcatcaacggctccaagaggacaccgacgaagcggaccactccgaagccgatcagcagttcagaaatgacaaaaaaaggaaaaagtgaggggaaaacgacttcccaccacatatttaaaccttgaatggaggctttaaaagattcatccggcaatacaatcatggaaatcgccattatcgaaacgctgaaggccaaaatggcgcttttgagtttagactggtacaatctgtgttcctcccctgtctttcaatccgcagcacttgctcgcttgtccttataaatcaaatatactcataggtctgtaaattagaccataaactgtacgaaagaaggacacgaggaggggggacaatggcgggccgcccgaaaatcggattggcgctcggctcgggaggcgccagaggctttgcgcatatcggcgtattgaaagttttcgaagaggaaggcatcccggtggatatgatttccggcagcagcattggggcgctggttgcggcgctgtacggggcggggcggactgtccgcgagatggagctgctttccggtgcatttaaacgcaaatattatttggactttaaaattggcaagatgggcctgatttcggggaaaagaattgaagatctgatccgtttgctcgttcatgggaaaaaacttgaagaattgaacccacctgttgccgttgtcgccgcaaatctttcaaacggcgaaaaaacggtgttcaaaaaagggccggttcaagaagcggtgcgcgccagcatttccatccctggcatttttgtcccgaaaaaaattggcggccatctttttgtggacggcggtgtggtggaccgcgtcccggtgtccgttgtaaaggaaatgggggcggagcttttgatcggggtggatgtttccgtcatgaaaaaagaagcggaaatccgccatatttatgatgtgattatgcaaagcatcgatatcatgcagatggaactggccgaaagccggaaaacggaagcccatgttttgatccgccccgatgtctcaatgtacagttcaatggcttttacaaatgccggacaaatcattaagataggggaagaagcagcaaaacaatccgtaactgaaatacagcaattgctggaaaaatggaaggagcccgacaaatgaaacaccgaaacatccggcggcgcatattgattgtggcagtgctgattcttgccctcctgtcctttgtgccgctgccttattatattgaaatgccggggagtgccatgcagcttgccccgctgatcaaagtaaagggcggctatcctgaaaaaggccaattgatgctgacgactgtccgtatgggccgcgcgaatccgtatacgtatctttgggcaaaaatgagaaaacacgaggatgtcgtaccggttcgtgaaattatggataaaaatatgacggacgaggaatacaatgtctatcagctttatttaatggaatcagcaaaacataatgccatccaggctgcttttaagaaggcaaaaaggccgttcagctcccattacgaagggatttatgtcctgaatgtatatgacgggatgccggccgcaaaagtgctcaaagccggggacagaattacaaaagtggacggccatgcattcaagtcttccaaacagtttatgaactatgtcgcaaagaaaaaagccggggacaaagtgaaattggactatatgcgtcataaaaaggcgaagatggcaaccgttgcacttgcaaaattcaaggaaaaccatcataaaacgggaatcgggatcagccttgtcgatgaccggaccgtcaaatccgacccggctgtgaaaatggataccgaaaaaatcggtggcccttccgccgggctgatgttcacattggaaatctacaaccagctgaccaaacaggacatcacaaaaggctataaaattgccggaaccggaaccatttcgccaaacggggaggtcggccgcatcggcgggattgataaaaaagtgattgcagcggacaaagcaggggcggacattttctttgctccagatgatacgattacacctgaaatgaaaaaagccgagcctggcatcaagccgaattacgaagaggcaaaagcggcggcgaaagaaatcgggacgaacatgaaaattgtaccggtcaaaacactggatgatgcactcgcctatttaaacggcctgaaacaaaaataaccggaaagccgcttgttttagcggcttttccctgtaaagaagggggaaggctgtcacgcatcccgggcttttgcctgcaagtctgaaatgtaatgtgggttccggttttccgcctgtaaaaagctgaaaatcatgcgtttcatcggtttttcgcttgcaaaaaggtgttagcctgcatgcctgcagttttttcgcttgcaaaaaggagaacagcctaagtatgcggctttctcgtctgcaaaaagccgtgctcatacaatcatgcgtttcatccggctttgccccagctgcatacgcgaagctttccgtctgtaaaaaggcagaatcaagcgtcacgcgccatccgttttttcgtctgcaaaaaaaggtggtttgctgaattcccggatcattaagtgttcccgttcgtttgccggaagcgggagggcatatatccgcgcggctcttatgtccggtgcaagcgacggggcagtttgcagcgaaaattttgaaataataggaaccggtaccgtttttttcacgctgttcaaatagcgccttcccgtttcgttcatggcgagcagccggatatacgccggctttgccgcatgctttttgatttctgcttttttggcattggttaacaaatgggtgcaaattcgctgcagtcttgtccatgtgtatcgttttgttttcactttttccatgaagtcgggaaaactgttggcagatgctgcggctttttttaaacggtattcaatgccttcttccacttcataaatggcgcgtaattcctcttctgaagaggaaagcagccggtagtgcaaaaaaggccagtaaagcgcccaatgcaggaagtgcccgttgttgttgcggtgccggctcagtacatgaaatgctggttccggcagcaccgggcgggcagcgtgcagatcttcggtttgcaagatggtttttctgatggcgcttgcacttgcaatttcaccggttatcgcgacgtcatggtgcccagccgcttttctttggacggtaaaagcctccatcgccgggttttgccttgctgccgcgagcatataatggaagccgagaatattattgggtgagcctaaatcaagtgcactgcctggtgcgagcttctgaaagctgtttgatagcgccgccggatagctgatcccttttttgacctcgcgcttgacggatgcgttaaatgccgcttcgttttgaagcaggacggcagccgcctggcggaatgcttcgatgtcgccggattcgctgccgaagcagaagcttttgcaccacaaagcgtccaaaatggcaatcccgcctgctgcaaatttttcggcgggctggacggcaaatgcatacggcagttcgacgacgagatccgcgcccgataatacggccatctccgcccgcgtccattttgaaacaagcgccggttcgccccgctgcataaaatagccgctcataacggcaatgatacactctgcacctgtcatccgccgcgtctcgcgaagatggtgcagatggccattatgaaaaggattgtactccacaatgatgccggtacttttcaattgtgattcccctttccggaagatttggatgtttaaaagcacccgtttgggataagttatttttaacataaccggcaaaaaaagcaatcctgcctgctgcaaaatttttttgaaaaaacggggagtcttgaagatgaaagcgtaaaaaggacgcgtcttaaacaaacccgggccggtttctggtttgaagaaaaattttcgttgtggacatcatggttgtaaagcaaaaaatattgacaaaaggtatgagggaagctataattacctttgttgtcttggggtgatgaaagtgaaatggtctgccattcaattgcaaaaatttcgggacaagcgctttgagatagatgaatcggttgatattacaaaagatttaatggaaactgattccgagatccgcggggcttcgccttttcacgtaacgggaacggggagtgctcagcagggcagggtgacgtttgaccttcacattgaaggaacgcttgtgctgccttgtgcccggacgcttgttgatgtacattacccggtagacttgaaatcgacagaaacgtttcttctcgagccttccgattatgaaggcactgaagatgaagaagtgcatgttgccgaaaatgaggtcattgatttgatcccggttatgaaagaattgattttgctcgatattcccatgcaggttttcagtgaggaagccaaaaaaggcgaactgccgcatacggacaactggcaggtgctgacggaggacgagtatctggaaatggagcagaaggcggaaaaagcggtagacccgcgtatggccgaccttgcgaaattttttgaccaggattctgaataaccgccatcttcggctaaatgatatgctgatctcttataaggaggtgggaagaatggctgtaccttttagaagaacttctaaaacggcaaaaagaaaacgccgcacacattttaaattgcaagttcccggcatgattgaatgcccgcgatgcggtgaaatgaaaatggcacaccgcgtatgcccatcttgcggttattacaaaaacaaagttgtggtaaataaataataaaagagcacggcgcaaacccgtgcttttttatttgccttcaaaacgccatccctttccgccaaaagcttctccccgttcctcctttttttctcgaaatttcgtctatcttttctatcaacggcatatgaatagtattaaaaaggatggggggaaagatatgccggcagtcagacaggatgcctggacacaggaagaagatttgctgctatcggacattgtgttgcgccatattcgcgaaggcagcacgcagctccgggcgtttgaagaggcagggaagcggatgaaccggaccgcagcggcatgcgggttcaggtggaattcttatgtgagaaagcagtacgcctcggaaattgaagccgcaaaaaaagaaagaaaggaaagaaagcagctcgtccgggatgccgtgagagcaccggctgaagaagggcagcagacagaagcaacgctgtttgatgccatccgtatccttcagcagcttgcggaaaaaagcaggcaagagagtgggcagttgtccgcatcccgccgcggtacagaggaatggaaaagcaaatatgaggcgctgcttcaaaagtatcttgaagaaaaggaaaagcatgagcagctgcaaaaagaatacagtgcgctcctttccattatggaaaaagcacggcagttgtctgaacaagattaaagcggcggcacatcccctggaccttaaaaggcaggggacattttttgttcgtaaaaggcaaaaaaagaaccggaatccggttctttaagaagaggtcgtttttttgtcctgttttgcgtctttcagcttcacgccgtgcggcaaccagacaaacgggttttcactcaaatcgcgttcgacattataaggaacaggtttgaaccccattttttcccaaaatcctcgcgacttcaggcgggcgtttgttttaatcggcagcccgaagcttttggcaaaatcaacaagcgcccggccgtaattcttatattgatagttcgggagcacttccagcttccaaagttccaaaaatgtttgcggggggtcaaaatagagatcgtattttgcatcccgttcgtaaaggctcatgcgcgcaacgagtttatcggcaaaataaatgccgtaaaatggcgagtcggcgttgtcttcaataatattgtcctgcaaatcttcaagcatggacagttcctgctgcccgtactctttaaactgcttgaattcttcgagcgttttgtagttcactttcagcctttccacttgataagccatatcaattcccccatccctctttatatgctgtgtcgcagcagcatggcggcgattcttacataaaaccggttgatattatcattatataacaaacaattggaagaatgaaagaaatacgtgtaaacggtcgcacaccatttgtctggaattttcttttccattcccttattgcctgttaaaatggagcaaagaaaatggaaaggggcgggcaaaatgaaaattggggtgattggcgctggtgcgatcggtttattatacgggggttggcttggaaagttgcatgaagtgaccttgtttccaaatacgaaggcgcaggccgtagagctgaatgaaaaagggattaccgtaaaagacggcgcatcttcgttcagaactttcgtcaaagcggatgacacgttctcttcgctttcctcccaggatctagtcattgttgccgtcaagcaatatgaccttcctgctgtgacaaccgttttaaaaaacgaagatggcggggtgccggtcttgtttttgcaaaacggcatgggccatcttgttcttcttgaagaattgccgcaaaaaacgatccttgtcggtacggtagagcacggcgcatcccggcttgacggcacaacggtgaagcataatgggcacggcaaaacgaatatcgccgtctaccgcgggaaatgggatgaaagcgtgcatttgcatacggatgctttcccgttcacggtgcagccggattatgagctgatgcttttgcgcaaatgttttgccaatgccgtcatcaatccgctcacagccgttttaaaggcaaagaacggggaactggtcaaaaacccgcattatgcccgtgtgttccgcgccgtatttgaagaactggcggcgcttttcccgaaactttcgcgggaaaagatgtgggaggaagtcaccggcatttgcaaaaatacgtgcgaaaatgaatcgtccatgctgaaagatgtgaaaaaaggagcacggaccgagattgacgcgattctcggttacatgctggaaacggctgcccgtcaaaacagccaggttccgcttgcgtccgccctttatgaaatggtgaaagggatggaggataaggggtgaggcacgttccgggtgttgccgccgtgcccgcagcggccggaaacatggcttctgtttttgaaaacgggcagccttgaaacgagcaggcaggctttttttctttttttcacaaaaatgctatactcaatgagaaaatcaatgaaaacgagaaaggaagaatcatttgatggaactggaaaacttttcaattccagcaacgaatcggttcgcttccctctatcttgcgcaaaaatctcctgtaaaggatttttttcattatgatataacggatgcttctgttttccataaaagagtggaagatttaaaaaaacgggcttttaaccgggaagggctggcagattgtatcgggcactatatggaaaaatttggaatctccccggagacggcccattccttggaaaaattaaggcagccgaacgctgctgttgtgatcggtggccagcaggcagggctattaacagggccgctttatacgatccataaactgatttcgattatccggcttgccagtgagcaggaagaagccctgcaaattccggttgtacctgttttctggatcgcgggcgaggaccatgactacttggaagtgaaccatatttatgccgaacaggaaaggcgtttaaaaaaatttagttatgctgaagggccgcttgagaaaaaaatgatctctgataccacaccggatcctgcccatttaaaaaaatggatacataaagtttttgaagcatttggcgaaaccgaacataccaatgcccttctttccaagctggaggcgtttgcagacagggcacaaagcctttctgacctgtttgcctgcatgattcacgatcttttcaaggcatacggggtgctgctcatcgattcggctgatgcacacttgcggaagatcgaggcgccgttttttgaacggatgatccaggattatgacaagattacggaagcggtcctctggcagcagcaggaaatcgcgcagtttgagtttccaaaagcgattgatatttccaggcgggcgctgaatcttttttattatgacgggaaggaacggattttgctggagtacagtccggagcacggcggatttaccgggaaaggcggcagccccttttttacggaggaagcgttgcgcgcgctttgtgcgaaaagccctgaacggctgagcaataatgttgtcacaaggccgcttatgcaggaatggctcttcccaacccttgcgtttatcggcgggccgggcgaaattgcgtactgggccgagctgaagcgggtgtttgaagaaatggggattctgatgccgcctctcgtgccgcgactcaatatcacgttgcttgagagaacggtccaaagggatatcgaggaactggaactcgatatcgggcatgtattaaaatacgggacccggaaagagcgggaaaaatattggaatgacgcaaaagatgagaatatggacgcgctcattgcagaaacggaaaacatgctgaaaatgcaatacgataaaatttttgccgcaattggaaaggggttggaaccgcttgcccgcaaaaatctcgattttcacctcgggcagcttgcgtttttgcagcggaaagtggatgaagagattgcgggaaaacatgaaaacatccttgaaaaatacgcgcgggtcgaacgtgccttgcgcccggacggcaatccccaggaaagggtctggaaccttttttatttccttaacaaatatggggcggactttatccacacccttgccgccctgccgttcacatttgacggcacacataaactcgttaaaatttaaccggctgacagcggccggctttttttatgcaaaaaaacagggggttttggttcacgatgctttgttggaaaaatgaattgtaaagacgcttcccgcacgataccgacgtggttttggttcatgatgcttttttgaaaaaataattgcaaagcgaaaaagcgggttgccgggactcaccatgttggaacaaggctttacggcaggcaagttttaaattgattttttcttgcaaaaagcaggaaaacggagctgcgaggagaatataaaaattaaagtggtgaaaggtgggggattgtggtaaattattaatatgaagtgggaagcggggggcacgcgccaatgttcatgggagaataccggcacaatatcgatgtaaaaggccgtttgattgtaccggccaaattccgtgaacagcttggcgatacgtttgtcattacccgcgggcttgaccgttgcattttcggttaccctgcggatgaatggaaacaggtggaagaaaaactgaagtcccttccgttaacgaaaaaagatgcccgcgcattcacacgatttttcttttcgggggcgaccgaatgcgagtgggacaagcaagggcgcattcttattcccgcaccgctcctttcctatgcgaaactcgaaaaagaatgcgtggtgctcggcgtttccaatcgaattgagatttggagcaaagatttatgggaagaatattttcaggaatcggaggcttcttttgctgatattgcggaaaacctcatcgattttgacctttaacatgttcgattggataggagattcagtatgtttcaacacaagaccgttttgctgaaagaaaccgttgacgggctacatattaaaccggacgggatttatgttgactgcacgctcggtggcgggggccacagcgcctatttgcttcagcagcttaccggcgggcatttatacgcttttgaccaggatgaaacggcgattcagcatgccaaagaaaagtttgcccatgaccaaaacaggatcacttttattaaaagcaatttccggtatttaaaatcagaattgaacgcgcgcggtgtgcaggctgtcgacggcatcttgtatgatttgggcgtttcctctccccagcttgatacaccggaacggggattcagctatcagcatgatgcaccgctcgatatgcggatggacctcgatgcgccgcttaccgcttatgaagtcgtcaatgaatggccgtatgaaaaactggtccggatctttttccggtacggggaagaaaaattttcaaaacaaattgcccgcaaaatcgaggcgtcccgtgccaaaaaaccgatcgaaacaaccggtgaactggccgatttaattaaagaagcgattcctgcacccgcacgaagaaaaggcgggcatccggcaaaaagggtctttcaggcgatccggattgccgtgaacgatgaattatctgcttttgaaacgtctttaacggatgccatttcgcttttaaaaccaggcgggcgggtctctgtcattacatttcattccctggaagaccgcatttgtaaaaatatattgaaagaatacagcagtgcaggagatttgccgcatgggctgcctgtcatcccaaaagaatacgagcccgtattaaaactcattacgaggaaacccattgtcccgaatgatgaggaagtgggcgagaacaaccggtcaaggtcggctaaactgcgcattgcggaaaaacgctaagaaaatagaggagggagttttttgagtaatttagcaaggcagccgaaacgtgcgctggaacagcaacaacagattgaaaaaagagtagcaccggccacaagacgcgcgcagatcactttaggggaaaaaatcatcgcaagcctttttgctttgttcgtgttgattatggccgtgaagatcgtatcgacggaagctgcaatttataatgtcaaccggtcgattgaagatacaaaaaccacgatccagaacaaaaacaaggtgaccgatgatttgaaaatgcaagtaagcgaattgagccgctacgaccgtatttacgaaaaggcaaaaaaactcggcttgaaattggacgagaataatgtcaaggttgttgaaaataaatgaagtccagaaaactgaatacaaacaggggggcagcgatattatttatcatattcggtctgtccttttttattatcgccgtaaggtttttgacgattgaaatcacagggcaggcagacgggaaagtgctcgcggcaaaagcggcgaaaaaatatttgcggacaagcgccattcccgcttcccgcggcaatatttacgatgcaagcggggaagtgatcgccgaaaatgttgtttcgtacaatctggtcgccgttttggacccgaaagtcacgattgatccggaacatccgaaacatgttgtcaaccctcgaaaaaccgcccaggcccttgcgaaatatattgacatgcccgaatcaaaaatttattcgctcctgacacaaaaagggcggtttcaagtggagttcgggaaggcggggcaggatattccgtataacgtaaaaaatgaaattcaaaaacagaacctgccgggcatccagttcgaagccgtgccgaaacgcacgtatccgaacggttcgtttgcctcccatctggtcggctatgcgcagaaaaatgagacaggcggccaaatggcaggtgtaatgggaatcgaaaaaagcatgaatgccgctttggaaggcaaagacggaaaaatcagttatgaaggcgacttttggggatatattttgccaaacgcgcataaaaaagtcaccaaaccgaaaaacggggaaaatgtctatttaacgattgacaagaaaatccagtctttcgttgaagatgcgcttggcaaagtccagaaacaatacaatccgaaaaaagcgtttgttgtcgtggccgatccgaaaacgggcaagatactggcaatggggcagcggccgacatttgatccggaaacgcggaaaggtttgagcgatgcttggcaggacgatccagtcgaaaccgcttatgaaccgggctcaacgatgaaaatttttaccttggcggcggccgtccaggaaggcgtttttcacccgaatgcgacctataagtcaggagaattccgggtgaaaaatgtgccaaacccgattaaagaccataatggcggggtcggctggggcaggatcacctttttagaagggctgcagcgttcttctaatgttgcatttgccacattgctggattatattaagcaggataaatttaagcagtatttggaagcgttcgggttcgggaaacagacgaaagtcggcttgccgaatgaagcttccggcaaaattttatacgattatccgattgaacggtatacgtcgacattcgggcagggtacaaccgttaccgcgatgcagatgattcaggcggcaacagctattgccaatgacgggaaaatgatgaaaccgtatgtagttgacaaagtggtcaatcccgcaaccggaaaaatggaaaaaacaaaaccaaccgttgccggcaacccgatcagcgcggataccgcgaaaaaagtccgggattatttgcggacggttgtgacgaataaaaaaaccggaaccggcacggcctataacattccgggctacgaggtgaccggcaaaaccggtaccgcccagatcccgaatccgaacggcggcggatatttaaccggtaccgataattatatcttttcttttctcggtatggcgccgaaagacaatccgaaactaatcgtttacgccgttgtccagcagccgcatttaaaagccggtgagcttggcggcgaaccggttaaagcgctgtttaacccgattatgaagaacagcctgcaatatttaaacattaaaccggcaaaagggaagaccgtacgccttgccaaacttcctgattttacgggtgacagccggtcagaagcgacatctgccgtaaaagcattggggctttcccctgttgtgctcggcgatggcgatgccgtaacggcccaggaacccggggcacaggaacaactgctgccgggcgcaaaagtatttttgaaaacaaatggcaataaagtaatgccggatatacgcggcttttcgaaacgcgacgtggcgggcgctgccaaactgctcggcctccgcctgaccataagcggggaaggttatgccgtatcccaaagcattccggcaaaatcaaaagtgaaatccggacaggcccttactgtaaaatttaaaaacccttaggcggccggtagaaggaataccgaaaaaaagcaagcacaaggcttgctttttttcatgcgtgtgaaaaggtactagccggatgcgtacaagcatataaatgggtataaaggcaacaaagggcattttatgcgcccggagcggatttttcagggttaaaggaaaccaagagaaggctgaaatctttcatctttcctacccaggaatctgctgctttgagatttaaatgaaggaggcgcgctcgtgaaacgtgtatccaatgttacggtgagaaagcggcttgtttttatattgctttgcgggattgtcattttcagcattatagatgtgcggctcggctatgtccagttcgggctcggggatatgctgacgaacagggcaaaagcgctatggagcagaagcatcccttttgaaggggagcggggaaaaatcgaagacagaaacggtgtgccgatcgcctccaaccaaagtgccccgacgatttttatcattccgaggcaggtcaaggatccggcaaaaacggctgaaaaactgggggacgcccttgatgcagacaaagaaaagctttataaagaaattacacaggtcagatcgattgtcagaataaaagaagggcggaaaatcagcaatgaaaaggcaaatgccgtacgccgccttgggctttcaggggtctatatcgcggaagattccaagcggtattatccgttcggccgttacctttcgcatgtactcggattcactggtgccgacaatcaggggctgaccgggctcgaactgtattatgatgatgcgctgagtggaaaaaaaggggcagtcgagttttatacggacgcaaaagggaagaaaaagatgaaggatatggcagatgaatatgaaccgccaaaaaacgggcttgacctgaaactaacggttgatacaaaagtccagacggttattgaacgtgaactcgataatgctgaaaaaaaatatcatccggacgggctgattgcgatcgccatggacccgggcaccggggaaattctcgggatgtccagcaggccgagctatacgcctgacaattatagaaatgtgccacaggaagtgtataaccggaacctgccgatctggagcacatacgaaccgggctcgacatttaaaattatcacacttgccgccgcccttgaagaaaagaaagtgaatttgacaaaagacaaattttacgattccggcgcggttgaagtcggaggctcgacgctgcactgctggaaaaggggcgggcacggcagcgaaacgttccttgaagtcgtccaaaattcatgcaacccgggctttgtcaaacttggcgaaaggctcggaaaaaatacattattcaaatacatccgcaatttcgggtttggcacaaaaaccggtgtggatctatccggcgaagcttccggcattttgttcaaccttgaccgcgtcgggccggttgaactggcgacaacggctttcgggcagggggtttctgttacgccgatccagcaggtggcagcggtctcggctgccgtaaacggcgggattctttacaaaccgtatattgcaaaggaactcgttgaccctaaaacaggggaaacggtcatgcggaaaaacccggttgccaaaagaagggtgatctcggaaaacacatcgaaacaaatccgccatgcgcttgaaacagttgtcacacaagggagcggaaaaaatgcttatgtggacggttatccggtcggcgggaaaaccgggacggcgcaaaaagccaaaaacggccgctatctcgaaaacaattatgttttatcctttatcggtttcgccccggccaatgatccgaaaatcgtcgtctacttggcggtcgataatccgaaaaatacgatccaattcggcggccaggtggcagccccgatcgcgggcacgatcatcggcgacagcctgcgtgccatgggcgtcaagccggtgaaaaaccaggcggaaaaagaaaaaagttattttgaaacgccaacggtaaaagtgccgaatttaatcggagagacgaaaaaagagatgatgaacgatcaatataatctcaaacttgatgtcagcggatccggaaacaaggtgatccggcagtcccctgaagcaggcgtgaaagtggaagagggctcaacgatccgggtttacatgcagtaaaatagattcaccaattccggaatgggccccgccaggctcaacaatccggaatttgcatgcagaaaaacagggcggcgccgtatgtccggccgcccgtgtttttgtttcaagaggcataaacaagctctttcggcgtacattttaaaaatcaacaggacttcatagcttaatggccgttttttttgtacaatagaaaaggactgtatttacatgtatacacaaagaagatgcagcaacaagggtttggaacaggaagggttggaagcaaaatgaagttacatacattgttagaggcattaccatttgtgaaaatgcctgcagtgaatccggaaattacggaacttgtccaggataaccggcttgtcacgaaaaacagtctgtttatttgtatcaaaggctatacggttgacgggcataagtttgccgttgatgcggccaaacggggtgcagcagccattttagccgaaaagccggtcgatgtggatataccggttattatcgtccgcaatacaaaacgggcaatggcgctccttgcagaccggttttacgggcagccgtcccgcaagtttcgtcttgtcggcattaccggcacaaacggaaaaacaacaacgagccatattatcgaaaaaatataccgggatgcaggcagaacgaccggcctgattggcacgatgtatatgaaaatcggcgatgaaacactggaaacgaaaaacacaacgccggacagtctgacattgcaaaaaacattccatgaaatgaacgcgcgcggtgtcaccgattgtgtgatggaagtttcttcgcattcgcttgttgaaggccgggtgcacggctgcgactatgatattgccgtttttacaaatctcacgcaggatcatctcgattaccataaaacgatggcggaataccggcgcgccaaaagtttattgttttcgcagctcgggaactcctgcccgcaagataagccgaaatatgccatcttaaatgcagatgacgccgcatcaaaagaatttgaacaagtaaccgcagtgcctgttattacgtacggaatcgaccatgatgcggattttatggccgaaaacattgacatgcacgcccgcgggacaacattcacgcttgtgacgccttttgaaaaacgggaagtccacctcaagctcgccgggaagttcagcgtctataatatgcttgcagcgatcgcagccggagttgtttccggggtgccgcttgattcggtcattaaaacggcggaagcgatggaaggcgtacgcggccggtttgaactcgtaaacggcggccaggatttttccgtgattgtcgattacgcgcacacgcccgacagtctggaaaatgtcctgaaaacgatccggcagtttgcccgcaaaaaaatctttgtcgttgtcggctgcggcggcgaccgcgataaaacaaagcggccggtgatggcgcaaattgcttgcaaatatgcggattatccgatttttacatcggataatccgcgcagtgaagatccgcttgccattttgcgcgagatggaaaaaggggtagaaggtgagcaatatgaatgcatccccgaccggagggaagcaatcaaaacagccattttccgtgcagaggcgggggatgttgtcctgattgccggaaaaggccatgaaacgtatcaaatcattggaaatgaagtgcatcattttgatgacagggaagttgcactggaaatgataaaggagcggtgaagcatatgttatcattcggggatacagcccaccttttcagtttgggccgcggcatggagatggcgctcgaatttgccacagtcagcgtgtttgcggatgtaaaccagccaaagggattatacgtccctttttctgaaccggacattaaccgggcaattgcacacggggcaatcgcggcgctttggaaaaacgatgcgcccgtgccccgctatataccgaatgattttccgctgtttatggcagaggatgtttctgttgcttttacacaactggtacagttttatctaaaaaaaatggaaagcaaggatttggatatgaagacaacttttattttttacggaccggaattgcgggaaaaaaaccctcatacatatgatttggcggatgcggaaaacaggaagcggctgctttgtgcatgcaggcgccacgggagggaaaaagcatgatcgagcaagtgattttttttacaacactgatggcttttttgatttccgtgctgctttcgcccgtttttatcccttttttaaggagattgaaattcggccagagcatccgggaagaaggcccgaaatcgcaccagaaaaaatccgggacgccgacaatgggcggcttgattattttggtatcgatcattgcatccacactgatcatggccggtaaattcgcagaaccgactgtaagaatttaccttttgctgcttgtgacgatcggattcgggctgctcggatttttggacgactttattaaagtggtgatgaagcggaatcttggccttacatcaaagcagaaactgctcggccagattctcgttgccatcattttttatgtcgttttccgccacttccatttatcttcggaagtctcgattccgtttacggacaaatcggtcgatttcggctggttttactttgttatcattcttctctggcttgtcgggttttccaatgcggtcaatctgacggatgggcttgacggccttgtatccgggacggcagcgattgctttcggggcattcgccgttttggcatggaaccagtcacaggcggatgtcgccctgttttcggttgccgttgtcggggccgtgctcggttttctcgtctttaatgcccatccggcaaaagttttcatgggggacaccggctcacttgcattgggcggagcgattgccgccatttcgattctgaccaatcttgagattcttttaattgtgattggcggcgtttttgttattgagactttgtctgtcattctccaagtgatatcatttaagacaacaggaaaaagaattttcaggatgagcccgctgcaccaccattatgagctttcgggctggtcggaatggcgtgttgtcgtgacgttctgggcggtaggccttttgtgtgcgattttaggaatttatatcgaggtgtggatgtaacatgaaaaatatcacggaatatgaacataaaaaagtattggtactcgggctggcgaaaagcggggtgagcgcggcctccctgttgcaccggctcggggcgtttgtgacggtgaatgattataaaccgcttgaagagaacccggaggcgcaggggcttttggaacaggggatcaaagtcatttgtggcagccatccaattgaactattggatgaaggctttgaactgattgtgaaaaatccgggcatcccttattcgaacccgcttgttgcgggggcgattgaaaaagggatcccggtcattaccgaaatcgagctggcttataaaattgcagaatgcccgatggtcggcattacgggaacgaacgggaaaacgacgactaccacgttgatttatgaaattttccaggcggatccgcatcttgatccgttaattgccggaaatattggcaaagtggcctccacggtggcgcaaagagcacgcgcggaccagcagatggtggtggagttgtcttctttccagctgatgggcgtgcaaacattcaggccgcatattgccatcatcacgaatatttatgaagcccatctcgattatcacgggacaaaagaagcttatgcaaaagcaaaatcaaatattacccgaaaccagacagaggatgatttcctgattctgaaccatgcccagccggaactgtgggatctggtctccttcacgaaagcaaaaattattcctttttcaacgaaggaatatgttgaagacggcgcatcggtaaaagacggcagcatcatgtggaaaggcgaaaaaatcatggaccgcgctgaaattgtgctgccgggagaccataacctggaaaatattttagccgctgtcgccgctgccaagctgatgggagcaagtaatgatgccatccgcggggtgctcggaacgtttaaaggcgttaagcaccggacgcaatatatcggcgaaatcaaaggacggaaattttacaacgattcaaaagcgaccaatatcctggcctgcaaagccgcactcgccgctttccatcagccggtcattctgcttgccggcgggcttgaccgtggcaacggctttgatgaactgatcccggctttgaaatatgtcaaagcattgattactttcggggaaacagcgccgaaactggaaagcaccgcgaaaaaagcaggcattccggtcatccgcacggtggaaaacgtggaagaagcagtcccggccgcatgggcattatccgaaccgggcgattgcattttgctgtcgccggcatgcgccagctgggaccagtacaaatcttttgaaattcgtggtgatattttcatcgacgccgtgcataagttaagataagggcttggaccgtttttggccggcgcgggttgccggtttttgcgggaagctctaaatcttttctggggtgggcgcggatgccgtcgaaaaaaacgaatcccgactttttattaatcattgtgaccctggcgctgcttgcaaccgggcttctgatggtgttcagcgcgagcgagatcgtggcggaatacaaatttaacgatgcattttattttttgaagcggcagctgctttttgccgggctcggcgtggcagcgatgtttttcgtgatgcgcattgattactggacgtggcgggcatgggcgaaaacgatcctgatcatctgttttgtgctgctcgttcttgttttgattcccggcatcgggcttgaacggaacgggtcgcggagctggatcggggtcggcgcattttccatccagccttccgaattcattaaaatggcgctgatcgcgtatttggcaaaatttttatcggagaaccagaaatacattacgacttttaaaaaaggcatgctcccggcgctggcgctcgtttttgttgctttcgggatgattatgctgcagccggaccttggaacgggaacggtgatgcttgggacatgcatcatcatgatttttgtttccggcgcccgcattgcccattttgtcatgctcgggctccttggtgtgggcggttttgtcgctcttgttttatcggctccataccggatcgcacggatcacctctttccttgatccatggtccgatccgcaggggaaaggatttcaaattatccagtcgctccttgcgatcggtccaggcggcctgttcggcatggggcttggggagagcaaacaaaaattccactatctgccggaaccgcaaaatgattttatctttgccattctttccgaggagctcggttttatcggcgggacttttgtcctgattttgtttgcgctattgctctggcgcggcatccggatcgcacttggcgcacccgatctgtacggaagcctgctcgcagtcggcattatttccatgatcgcgatccaggtgatgatcaatatcagcgttgtcatcggcctgatcccggttacaggcattacgcttccgttcatcagttacggcggctcttctttgacgttgatgcttgtcgcagtcggcgtgctcttaaacatcagccgccattcccggctgtaacggaaggagaacctcataaaggggttcttttttcgtttgacaacaagttaacattttggtaataatcgttttactgtgcacccattgtcgtttaaaatatagtagtatagaaaaatgaatgtttcaaacatcatatattgatacccgtgcaacccagcacggcgtcctgaggtggaaaaacatgaaaatcattgtcagcgggggcggaacaggcgggcatatttatccggccctggcattgatcagaacgatcaaacagaaacatcctgacacggaatgtttgtatattggcacggaaaaagggctcgaatcccggcttgtgccgcgggaaaacattccgttcaaatcgattcatattacggggtttaaacgctccctttcgtttgaaaatgtcaaaacggttgtccgctttctaaaaggggtaagccggtgcaaaaaaatcatccgcgaattcaagccggatgtggtcatcggaacaggcgggtatgtatgcggtccggttgtctacgctgccgccaaactgcacatcccgaccatcattcacgaacaaaacagcgtgccggggctgacgaataaatttttaagccggtacgttgacaaagtggccatttgctttgaatctgcaaaatctttttttgatgagaaaaaagtggtgctgaccggcaatccgcgcgcatcggaagtgatcggggacaaaaggcgcggcgtcctttccggtttcaacctgaaaacaacgcttccaaccgttctcattttcggcgggagccgcggggcacgcccgattaatgaagcggttgtgaaatctttttccaattttgcacaaaaaaattaccaggtcatttatgcgacaggggatgtgcattatgaggccgtcaaaaaagaaattgcattgatcggcgaaaaaggaaatatcaaggtggtaccgtttatccacaatatgccggaagtgttgcgagcggtggatcttgtcgtctcaagggcaggggcaaccacattggccgaactgacggcgctcggtttgccaagtatcttaatcccgagcccttatgtgacaaacaatcaccaggaaaaaaacgcgaaaacactcgtggaaaacggcgcagcttttatgctgcttgaaaaagatttatcttccgcaaagctcgtatccttgattgataaaattttgctggatcgggaacagatggagaaaatgcaggcggccgcccgcaagctcggtattcgtgacgcttcatggcggctttatgaagtgatggaaaatctggccgcaaaagccaaatcgtgatgcggcaaataaaaaagggaggaacaaaatggcgcggtctgacaaaaacatcgtttcgctggaagaccggatcccgaaattaaagcagcagcgccgccgaaaaacgaaccggcggctcatcatgctgctgacggttttttttatgctggtgatgctgatcatctacctcgagtccccgctgagccgcgtccaccgcattcagatagagggaaatgaggcggtcagcaagccgtacattttgaaaaaaagcggcattgccacgggtgagaatatatggaatatccgtaaagacgcagtccggaaaagaatcgcatccatccctgaagttgattcggtgaaagtgggcatttccttgccgaatacgctttacataaaagtgaaagagcatcaaaaaatcgggtatttacagcagaaaggcggttttttgccggttttggataacggttcggtcgtcaaaagaacggtgaaagaaattccggccgcaagcctgatatttaccggtttcaaacaggatacgcatttgcatgaaatgatccgccagatgcaaaaattgccggattcgatcacaaatgccatttcggaagtccgctataccccttcaaacgttgaccgtgaccttgtcaccctgtacatgaataacggttttgaagtgcgcgcaagcattccgtcgttcgcagaaaagatggcgcattacccttcgatcatcagtcagcttgacccgaagaaaaaaggtgtgattgacctcgaagtcggttcgtattttaaagcttacgattcgaagtagacatgaaaaaatttcgcttttctccgtgtccatcttagtgtagacttatgatgaaaccaaattttaggaattgctatattttgagactggaaatattttgatcaccaaaagaaaatgaaaaaagtccgattgaaaaaaagggaatttgattatgacgcagaatactttgtttataatcacctttttgaatggaggcttctggcggactcacggacggaacggcaaaaagagcccgcctcagaagagacgaattgggaaaaatggcgctttaacataggcggattgcgtttgatcgaaaggcaaagggaggtgccgcagtatgaacagcagtgaaatatatgtgagtcttgacatcggtacatctgccacgaaagtcatcattgccgaaatgggcaatgattcattaaatattattggggttggcaatgtcaggtccgaaggcattaaaaaaggatcgattgtagatatagatgaaaccgtcctgtccatcaggcgggcaattgaacaagcggaaagaatggtcggcatgaaaattgaccacgtgatcgtcggcattgccagcaatcatgtgatgctgcagccgtgccacggggtggtggcggtccagagcgagaaccgggaaattacggacgtggatgtacaaagagtgatggatgcggcgcaagtgctttctattcctcccgaaagagagattgtgaatgtcattccgaaacaattcattgtggacggtttggatgaaatacatgatcctcgcgggatgatcggtgtcagattggaaatggaaggcatcattgtcacgacttccaaaacgatcttacataatacattgcgctgtgttgaaaaggccggcctgaccatcgcggaaattgttctcatgccgcttgcagccggtgccattgcgctgtcaaaagatgaaatggaactcgggacggcactcgttgacatcggcggcgggtcgacgacgctggctgtttttgaaaacggccatatccggacaacgagcgtgctgcccgtcggcggggaccatatcacaaaagatttgtccatctgtctaagggcttcaacggaagatgcggaaaaaatcaaactgaagcacgggcacgcgttcagccaggatgcgctcgaagacgatgtttttgatgtacagatcatcggcagtgaacaaaaagaacaatttaaccaattacaaatttctgatattatagaagctagattagaagaaatctttttgtttatccagcaggaactgaggaagatcggcgtccatgatttgccgggcgggattgtgctgacagggggcactgcaaatatgcccggtgtaccggagcttgcagaaacggtctttcaaaaccgcgtaagagttgccattccggattatatcggtgtccgtgagccgcaatatacgacggcggtcggcctgatccagtacgctgcgaaaaatgcgcggctggaagggaaaaatgtcagctcccgcctggtggcagccggaatggagtatgcggaaccgaaaccggcgaaaaagccgcagtccaaaccaaaacaagcttccggtcaggaagaaaaaatgtcatcgaaaatgaaaaaattctttggtttgtttttcgaatagcctgccggcatcatgtgcgaaaaaaccggagcccgtccggcagcaggaccgggataagatacgcaatacgaattaggaggattagtgaatgttagagttcgataccaatgtagacgctttggcaacgataaaagttatcggcgttggcggcggcggaaacaatgccgtgaaccgtatgattgaacatgatctgcagggcgttgaatttattgccgtaaacacggatgcccaggcattaaacctttccaaagctgaaattaaaatgcaaattggcgcaaaattaacgcgtggcctcggtgccggcgcaaatccggaagtcgggcggaaagcggccgaagaaagcaaagaacaaattgaagaagcgttaaagggtgcggatatggtgttcgtgacagccgggatgggcggcggcaccggaacaggggcggcgccggtcattgcccatatcgcaaaggaactcggggcgctgacggtcggtgtggttacaaggccgttcacattcgaaggccgcaaacgggcaaaccaggcggccggcggcatcagtgccatgaaagaagcggtcgatacgctgatcgtgatcccgaatgaccgcctgctggaaattgtcgataaaagcacaccgatgctagaagcattccgggaagcggataatgtgctgcgccagggcgtacaagggatttccgacctgatcgcggtaccgggcctgatcaacctggattttgcggatgtcaaaacaattatgaccaataaaggttcagcattgatgggaatcgggatcgcttccggggaaaatcgtgcgacagaggcggcaaaaaaagccatttcgtcgccgctgcttgaaacgtctattgacggtgcacaaggcgtgctgatgaacattaccggcagcgcaaatttaagtttgtatgaagtgcaggaagcggccgatattgtcgcctccgcatcagaccaggaagtcaatatgattttcgggtccgttatcaatgaaagcctgaaggacgaaatcgtggttacggtcattgcaaccggctttaatgaagaagcgcagacccagagcaagcagcgcccgtcgctcggacaatcaaggccggccttgaaccaacaggcaaaacgcgaaacaaagcgtgaagaaccccagtctgaaccgcaacgcgccgttcagtacagtgaagatacacttgatattccgacttttttgcgaaaccggaacagaagaaaataatgaaagagcccgtctctgctttccaggccattgtctgaaagcaaagacgggcttttttgcgtttgaaaacactttttaaacccgttttggattggcgagatgtcgtctgcatattgagagcaccgcagctatgtttatgttgctaagttgttttgaatttgcgagatgttgtctgtatatccagtcggggtttttttcggatgcatatcggtgtgacaacagaatcgagcaagcatgcttgacacttttcggctaaaaaaatgaaaagttctgtttttttgccagcagaaactgacacactttaatgctccgcgtgcgttatactagccataaatctaatcaaaaggacagaagcagcaatcggcaaaagagttcgcctggaagccggaaattggtttgcactatgttcattcaccggattggcgttcttaaagccgcagcagatgcacctttcagcaacaatcaccgggtaaagccttagtcgatgtacctttcaacaacgttaccgggttagtatacgaaaaccggcacaggatgcattgcggcaagcattccgcagcctcgggcacgcggcccgggcaaaagcggccgtcgttttggcgggacggctgcggattcatttgaggcggagacaggggggatgcgtttggttgtatatatggatgccatctggcttttgaattttcttgccgacagcctgctgttgtggctgacaagcattgccttaaaacggccggcccgcctgctccggattcttgcaggcgggctcatcggttcagcgatcatcatcatgggctttatgccgcagctttcttattatgccggtaacccggttgtaaagctgcttttttccggcatcatggtatttgcagttttcggctataagcggtggcgctattttttttcaaatctcctaaccttttattttgccacgtttctgatgggcggcattttaatgggggcccactactttttaagctttcacttcgacatgcaggtgaaaatgcttaaagctgcggcggggggatttggcgacccggtcagctgggcgtttgttgcgctcggtcttccggcggcatggctgttttcaaagaaccggattcaggggcttgaaatggcgaaaatcaagtatgaccagcttgtcgatgtttatattcgcatcggggaaagtgattttacagtaaaagggctggtggatagcggcaaccagttatatgatccgctgacaaagctgccagtgatgatcctttccatcctgcccgtccgtgagcatctccccgaagaaattgcggtgcttgcggaagatgcgacccgtcttttggacggaagtgctacacttcctgacgaatgggccggccgcgtccggttcatcccggcaaaaacagtcgggaaacaatcgcttcttttagcgtacaagccggatgaggtacaactgacgagcggaaaccggacatggcctgtaaaaaaagtgctgatttctttttcggcacaacgtttatccggggatgatgcattcagctgcattgttcacccgcaaatgatggcagaagctgcgcaatccgcctgatggtgactttaaagtcctacggtgtgatgtcaagggttaaaaacaagtgaacacattccttgaggatgggagacttctttcggaaatacgttaaaaaaacgggccggaaaccggcccgtttttgtcattttttcttggagagccatttggcgactttttgggcatcgtctccctttaaaagccctttcggcatatctccttttccgttttcaatgacatttaaaatctgtttttcgctaagcttagaaccgatatgctgcaaattcggcccgacattcccttgcaattgatcgccatggcaggcagaacatttttggtctgccagtttttcggcatcgccgccacttgccgtgtttttcccgccgcctgatgatggagacccgttcccgcaggcagcaagcccggctgcaagcagaaccgccgccaaagctgcgcaccattttttcacacgaagccctccctcctgtgcacattcttcttccattataccggatggccgcccgggcttggcaagaaatacgaaaaacgcgtaaacgcgcggctacggcatgttaaaaccttcgcccagcacttcggcggcatccatcacaacaacaaatgccttcccgtcaatggttttaacaaggtttcttaacttaataaattcagactgatcgacgacacacatgagaatcggtttttcatggtcggtaaatccgccatatgcatggagccttgtaaccccccggtcgatctggaacaaaatctctttccggatatcctcgtgtttgtcagaaatgatcagtacattttttgaacggttcaggccgacctggacgaggtcaatggtcttgcttgtgacaaacagcccgatgattgcatacaaacccttttcaatatcaaaaacggcagctgctgacaggacaacaagcccgtcaatgccaagtacacatttcccgagtgagatgccggtaaatttatggataatttgcgcggccagatcggttccgccggttgaagccctgccaagaaacacaatcccgagcccagccccgacgccgattccgccaaaaagtgcggccagcaatgcgtcatgcgtccacggctgccaatcttccgttaaaaaaacaacaaacggcaaaaacacggtgccaacaagtgttttaatgccaaattggtaacctaaaaaaatgaggccggcaataaatagcggaatgttaagcccccattgcacataggccggcttccatccgaacagcccgtgaaaaatcgtgctgatcccgctgacgccgccggacgcaatattattcggaagcaggaaaacattaaatgtaatcgcgacaattgccgacccggcaagtatgtatccatattccatcatcatcgtccggtatttgttcgccggttttctccttttctttgccatgtccatcccccttttcataaaaaaacggatgccacacaccaatatacaggaccgcttgtttcgcacccctcatatattttccggcattgtggcatccgggcctgtcatgcgttcaattttcaggaaaacttttttcttattacgaaatatgtgagcgcaggtaagcatcaatgaacagatcaatttcgccgtccatcaccgcctggacattccctgtttcaacatttgtccggtgatcttttaccatggaatatggatggaacacataagaacggatctggctgccccacccgatctctttctgttcgccgcggatttccgccaattgtttctctttctcttctacttctttttggtacaatttcgccttcagcattttcatggcttgttcgcggttctgaatttgcgaacgttccgattggcaggagacgacaattccggtcggaatatgggtaatccggacagccgaagacgttttgttaatgtgctggccgcctgccccgcttgcccggtatgtgtcgacacgcaaatcttccggccggatttccacttcaatattgtcgtctatttccggcatcacttcgcacgagacgaacgaagtgtggcgccggccggctgcatcaaacggcgagatccggacaagacggtgaatgcctttttccgctttaagataaccatacgcattatgccctttgaaaagaagggtgacacttttcacaccggcttcgtcgcccgggaggtaatcaagggtttcgactttaaagccttttttctcgccccagcgtgtatacattctgagcagcatggaacaccagtcctgggattctgtaccgcccgcgccagggtgcagttccaaaatcgcattgttcgcatcatacggtccgtttaaaagcagctgcagctcgtattcatttaatttttccgtgaacgcttcaagctcagcctcgagctcttctttcagttccgagtcattttcttctttggccagttcgtgcgtgacttcgagatcctcctgttgcgactcgagttcacggtagccgtttaccatttcttttaaagcattggattcattaataattttttgtgcttcctgctggtcgtcccaaaagttcggttccagcattctttcttccagttcagcaatacgtgtctctttttcttctaattcaaagagaccccctgaaacccgctaatttcttagctgtattttccaattccgctctaatttctgataactccattccattcacctcattaaatttttctgctgttttccgcaaaaaagaagggcggcgttttgcccctccttttttgcgtatgcctgcctgattttaagcctcaagccggccgtggcagtttttatactttttgccgctaccgcacgggcaagggtcattccggccgatgcgtacttttttgcggaccggttttttcttcacagttgtttcttccccgcccggcacgacagcctggccttttgccacttcctgccgctccagattggtttggatttctgctttcataatatattttgccgtatcttcctcgatggatgcaaccatattttcaaacatggcaaagccttctgactggtattcgcgtagcgggtcgatctggccgtacgcgcgcaagtggatcccttcgcggagatggtccatcgcatcaatatggtcgatccattttgagtcaacagagcgcagcaaaatgactttttcaaattcgcgcatctgttccggcccgaatgcttcttctttttcatcatagcgcatcttcacttttgccatgatcaagtcaaccatttcgtccggttcttttccgagcaagtcttcccgcgagatgtcgccttcacgaagcagattggtcaagacataatcgacaatgccctgcaagttccattcttcctcatcttcatgaagcggtgcattagcgttgacaacgcgttctacgaccgagcggatcattttttcaacgatttcacgcaaattatccgccgtcagtacttcatcgcgctgcttatagatgatctcacgctgttgccggaggacatcatcatattggagcagttgtttccgggcgtcaaagttattgccttccacccgtttttgtgcagattcaacggcgcgcgacaccattttgctctggatcggctgcgtatcatccatgccgagccgttccatcatgctcttcatattatccgatccgaaacgacgcatcagttcatcttccattgacagataaaactgtgtgatcccgggatctccctggcgtccggaacgcccgcgcaactggttgtcgatccgccttgattcatggcgttcagttccgataacggcaaggccgcccagttccacgacaccgtcgccaagcttgatatcggtaccgcgcccggccatgttggtcgcgatcgtgaccgcgcctttttgcccggcctgtttgatgatctccgcttcacgcgcatggtttttcgcgttcaacacgttatgcgggacgcctttctttttcagcatttgggaaatcaattcagacgtttcgatcgcaaccgtcccgacaagtatcggctggccgaggtcgtggcgttgcttaatatcctcaacaacggctctgaacttgccttccatcgttttgtaaatcaaatccggccggtcgtcgcggatgatcggtcggtttgtcgggatcacgacaacacgcatgttataaatgttgcgaaactcttcttcttccgttttcgccgtaccggtcatcccggccagcttcgcatacatccggaaatagttctggaatgtgatcgtggccatcgtcatgctttcgttctggatctccacgccctcttttgcttcaatcgcctgatggagcccttcactgaaacggcggcctttcatcaggcggccggtgaactggtcgacgatgatgatttccccgtcctgcacaacatagtcgacatcccggtgcatcgcaacattggctttcaacgcctggttaatatggtggttgattgtcacattgcggatatcgtacaggttgtcgatatgaaaatatttttcagctttcgtgatgccttcttccgtcagcagcacactcttcgttttcacatcataagtgtaatctttttctttttccaatgtacgcacaaatgcgttcgcttgtgtatacagtgctgtcgatttttcagcttgtccggaaattataagcggcgtccgcgcttcatcgattaaaatcgagtcgacttcatcaatgaccgcaaaataaagcggccgctgcactttttgttcctggtaaagcaccatattgtcgcgcaaataatcgaagccgaattcattgttcgttccgtatgtgatatctgctgcatatgcggcctgtttttcttcgttcgacatattggttaaattcaggccgacagtaagcccgagaaatttatacagctcgcccatttcctcggcatcccgcttcgccaggtattcgttcaccgtgacgacatggacgcctttcccggacagggcgttcaaataaaccggcatcgtggcggtcagcgttttcccttcaccggttttcatttcggcaatatttccttcatggagcgtaataccgcccatcagctggacatgataaggataaagcccgagcacacgcctggcgccttcccggacaaccgcaaaagcttccacaagcaggtcatcaaggctctcgccgttttggtaacgctgcttaaactcttccgttttgtcgcgcagctgctcatccgacagcctttccatatccgacgccaattcttcaatctggtttgcgatcttctcaagatgtttcagttcacgtttgttggcatcaaaaactttgtccaaaaaagccaccattcaaaacgctcctttatttcagtatcaaaacaggactgtttcggccctatcattgtaattgccatgacttttaaatattaattatagcacagtttcttttctgcgtctctttttccgccgggttttcccggccatgttaaatcagggtttccatgctttttggggaaaattccgatgatacagcccaggatttgccgggtgcgtgtattttgtttcctgaaatataccttattgtattgtaacactgaaacggagcgcatacaacaaaagaacccggagacaggctgccggtgcttaaggctaaaaatcccataaaaaataaacaaaatattgccgctctgttgcctgctgcaaaaagccatcgccatgcaaatggacgcccggggctgatgcacaacttcaggtatatcgtctatatcgtcctttaaaatccatgccgggcaaccggtttttaacctccagggagattccggctttcccggttcggcatgcccgggccgctgtctgaaaaaaaatgaagaggcctgagcacccatttggaattggaaaagcgttttaccaggccgccaccatgccgtccgcacgcgattccgtgccgcccatcagtacgcccgtgtccaggttgcgccagatgatctggccgcggccgaaaccgccagtatccgcagccacttggacatcgtgcccttttcggatcagcccttgcacaaggtgattcggaaaatggggttctaccagcacttttttcccctccgtccattgccatctcggggcatcgagcgcctgctgcggatgaagatgaaaatcaatcgtgttcatgatcacttggaagtggccctgcggttgcatatagccgcccatcaccccaaacggcccgaccgcttccccgtcttttgttaaaaagccgggaataatcgtatgatacgtctttttgccgggtttcaatgcattcacatgcgtttcatccaaagaaaaatcatgcccccggttttgcaaagcaattcctgtgcccggaacgacaatgccggagccgaatcccatataattgctttggatataagaaaccatattcccttccccgtccgctgccgccaaatagacagtgccgctctttggcagttcatacggttccggatccagcgccagatccccgatcagcctgcgccggtttgcagcatagccttccgaaagcaagtgtgcaatgtccgccttcatttcaccggcatctgtaatgaacgctttgccgtctgtaaaagcgagtttcattgcttcaatttgtttatgataggtatccacgcagtctttttcacgaaattcaaatccttgcgcaatattgagcgccatcaacgcaacaagcccctgcccgttcggcggcatttcccacacctcatagccccggtagctggcggaaatcggctccacccattcgggatgataagcctccaaatcttccctgcttaaaaagccgccccatttccggatacaggcactgattttttctgcaagcggccccctgtaaaaactttctgctttcgtttccgcaatttcctttaatgccgcggcatgcccgggcgatttccacacttccccgatagccggcgccctgccgtccggcgcaaacgtgtcaaaccatggccggaacatttcttctttaaaaatcgtttgaaactggcggaatgccctttcccagtattttcccaaaaccggcgaaagcgggtacccctcttccgcataccggattgccggttgcacaacgtctgccagcgggagccgcccgaatttttccgatagcgccgcccatgctgccggcgcgcccggcaccgtaatcgggaccaccccataagccggcattttttcatacccttgttttttcacggcctcaatggaaatcgactgcggtgtgggcccgcttgcatttaaaccgtgcagtttcccgcccgcccaaacaatggcgaatgcatctgaaccgatgccgttcgaggccggctccacgaccgttaaggcggcggctgcggcaatagcggcatcaatcgcattgccgcctttttgtaaaacttcaaggccggcctgggcagctagcggctgtgaagtggcaaccattccttttttggcaaaaacggtatttctggtggatacataaggatgatacaagtaatccaggtccatcatctttccccctcgtatagaaatgtctgtccctgcactggcctttcctgcaagcggatgccttgccggctgcccgccccccggtttccagtccgccatccgggcttttctcgcttcctgcttgccttttttcttctctatcctaaacataggcaccggctcattttcacctttctgccggggccgcgtccactgcagcatggcggctaattagacaaaagagccatgtctgccaagggttttgtcccgatagaagctccaattgacaaaaccaccggcgaagcagggcgaattgtctaattaggtcttctatcctgaacataggcaccggctcgttttcacctttctgccggagccgcgttccttgccggctcgcgttgtgtgctaaaaaaccgccccccggcccgctttgctttcaccggataggcccatgctgcaaaagcacccgcggattcaccgcgggtgcttgcttcgccattcccttattttgtttcaatcagcccgtatttgccgtctttgcggcggtatacgatgttcgtatgatttgtttccgcatcggtgtaaatgaagaagttgtggcccaaaaggttcatttgcagcactgcttcttcactgtccatcggttttaagttaaaatgtttggtccgcacaatttgcagttctgagtcttcttctttcctggcttgtttttctttcagtacggcgtccggagtgaacagttccctcgtgcttcctttttcacgcagtttccggtttacttttgttttatgtttgcggatttgccgctccaatttgtcagcaatcaggtcaattgccgcgtacatatcctcattggtttcttccgcgcgcaatacgagctgcggcattggaattgtaatttccactttggaagttttatccggattgactttaagttttacattgacggaagtgtctggcgtttctacgaaataccgatccaacttgttcacttttttctcaacataatcccgaatcgccggagttacctcaatgttttcgccacgaatgttgtagttcatcatgtggacccctcctcatcaactggcagccccttgcataccgcggtatgctcgtactttcactttgcacggtaaaagcgctgccttctctaataatcttacacttatatatttacacatttcctgtctaaattccttcttttttggcgaatttttcttagaaatatttgtcatccccctgttgccgctgtaaaaagcagccatcatgccggtttacacggcctttcccgaaaaaaagaagttctgcatcgatcagaacttctatcttttccggtcataaaaccttccatcatttaactgcagggactggtacggatttatatactgcttcatggacgttttctttttcgcagcttgctgaatatcgttccggatgccggacagcgttttctgcatcaggggcttcaattgtttgtcgagatccatgatttttcttccaagccattgcgcttcagcggaaaaaggcggtttcatggcagcaagcagcgccccgcgccggtcgaggagccggtggacgttttggatcaaagtttccctcggctgttctttatgaaattccgaaagcagcgcttccgtcagctccaggcaggcggcaagatcgcccgtcatactttgccgccctgcccgtatgtttgccggcggttcgcctggatgacctgcttccaggtgtcacggaaaccctccaccaattcttccgctgtatccagttttgacacgtcatttttcacattggcctggatcagttcgcgcaggataaaatcgtaaagggaaagcatcttttccgcttcttcaaatttgcctgtatccagcgtcatcatcaattcgcggatgatgttttgcgctttttggatattttgatttttttcttcaaaatttttgttttcaatggatttttttgccaaatggataaatttcaggcagccattgtacagcatcaatgtcagctcacccggcgatgcggttgcaatcgagttgttctggtacgcctggtatggattacgtgttgccatttgcggcccctcctttaactattgctgaaaaagctggatagataagtatattggctgttgtatttttggattgcttgttccatcgctgtaaactgcgcataataacggtcttcaagcttgcccagtttgtcgttcatgtcacggattttatccgtcaaatcgttgatgtttttcccgatcgtgaactgggtgttcacataagtggatttcccggctttgtcaacgatcgtgttataagtattattgacgctgtcgtacagcctttggacaatgcctttttccgatgttgtgctgccggtcgcgcgaaacagcagttcaaccgaatccggatcgttttggatcgcggccttcagcttgtcttcattaatttctagcttgccgccttcaagccagtcggaagtcgttgtgatgccgatgcttgatagctggttgtattcggatgaaatattggcgttatttacttttgaataaatcaatgaccgcatgttcgacagggaacttttcagcgtcatatcattccttaaaaggccgcttctcgcttttttatcccattggtcctgctgcgtgtccgtcaattccttgcgttggtcgtccgtaagcggcgcataatccgggtagcggtcttcattcagcttcgactgcacggcatcaatcaggctgttgtactggtccacgaaatttttgatgttgttgtagatggtgtccacgtcgttggaaaccgagatggtgaccggcgagtcgaattcgctttttaacgtataggtgacgccgctgatggtgaaggtgtttgatgtccgttcggtatccaacccatttatgttgaacacggcattcgtaccaccgtgttcagtgtcagtgctgccgctaaattttaatgtatcccgcaaaaaatcgtaagtatctgtatcagaagaaataatgatttccttaccatccacagatgaagacgaattaaaattaccggtctcttttctcgtcagcgtaaacatatctttatattcgtcataatacattgtcaaacctaagtttgaattgttcactttagaaatgacatcatttaacgttttatccgcgccgatataaaaattgccgttcaccagcccgcttgaagtatacgtttttaagttaaaagaagtgtaattttgctggtagctgatttggatagcagaaccgctataaattgacccgaaatcgctattaaaatcaatttttcccgtttccggattaagggtgccgatctgggtcgaaccaatgaataaattcatatttccgtccgtgccttgggagagtgagacgttattgtttccaactgtcatagtaaatgaatcggtgataatgtccccaaagtccaattgtattgatttcgtatcagacgagacggttgcactttttgttgctttatccaccacgtattcaacactaatgctcgtcccggcggaaatatttgaattaaattttaatgttgcctgcccgccagcagttgtaagtaaaacctggttatcactgagcgtaacggacggatctgtcaccacttcataagtttttccgttcatttttacattcattggcatattactgttaagtgtgccctttaagtcaaacgtaacagacgttggatctgtggagtcccctttggctgttatggtatccgatattactcccccttggctccattcgattgacctgctgaaatttcctgactgtttccataaggattgattcaaatcaaccttattggatgaatctgttgaaattggggcttcggctaccctcgtcgctgccgtcgccaattgtgttacactttgaattgtcgttgaccccagcgatgcattattcgccgctgttgccgttacatagctttcatttgatgaagtcgtcgtgcgtgccctgtacttggaagtcaatttcatgttggacagcgtggagcggaagtcaaaatatttttggttcagcgtccggtagtcttcttcctgccactccaaaatttgcttttgctgctgcagtttgaccaaaggctgttttgccacggtcatcattttttcgacaatagaatcgatgtccatgccgctcgcaagccctgtaattctttgtatggatgtcattcaatcccctcctttatatcttttcatcagccagaatcccgacatggtgcagcatatcggcatacgtatccaaaatcctcttcggcggaatttctttaatcacctggtccgtcttgtcgtcgataatcgtaacataatattcttttagctggtcatgaaattgaaattttaaatgggtggaggatccggacaggaaatggttcagctggtccaccgcttttttcactttttctttcgtttcttcattggcgggaaggatttgttccctggtttgttttgtcacaattggcctggcctgatccgccccggttgccttttgtgcctgcggtgtactggttgcaagaggcggatgcgcagcctgccactgcgtcgctccaatcatagcaagttctccttatgttccggcgttcccgccatgccttgtttcatggcggaacaaaaccgcttttttgtctactatttgtatcggatgtttccagccgtttttaacatccgccgctttaaaatttcactttggcgaatgccttacctgaagccggaggggttttttcagaggtgtccatgccggaacgggtgaagcagcgcaaatttttgggataaaaggcaaatacccatacaggcaccgggtttttcacatatgctttatcgtcaaaaaataatggggttgaggaggaaaaaactttgaatacaggttatcaagaagttccttattatgaaacattgaaccatgaagatgtaagattgcccccatggggatttggaggcttcggattccggccatggggttttaggccatggggcttcaggccgtggggattcaggccatggggattcggttttggcccgttcctcggagggtttgcaggcggcctggcaacatcggcattgctcgcacctgcgctttacggcggctacggcttcccgtacggcggctacggctatttctggtagtccgacgcaagaagccggcctttaagccgatttcaactttgcgccggcctcccgtttaagaaatagagtagcggatcatttgctggttttaataagcgatggtcgttggacacaaggcgtaaagaatccgttttcatataatcgcccggcaccggctaaatgccggtgttttttctctttggcactttcttcacgcaccgcctttgccgtttacgcccgcctcgatacataacggttttcttttatccagaaccggtacgggtaatgtttggcttcaccggtgttatcgattccgatgcgcgggccggtttcgatttgttccggttcgtatccttccgcaataaagagcgggcgttcgtaaaatacgcgcccgtagtcttccattgtaatgcctaatgcttttgttaacttcccgggaccgtttgtgagttgctttgcttccttgactttccggcgggcaaacatcagctccgttccaataaaaggttccacggcacggatcaggatggcttccggtgtgccttcccggccgctgacgacattcacgaggcagtgggtgtgcatttggtatgtatacacgtggcccgggccatggtacatgatttccgttcttttcgtccgccggtttccataactgtgcgcggccctgtcccatgcacccatgtatgcttccgtttcgacaataaaaccggccgccgtcccttcttccgtctctttgacgagcaggcaaccgagaagggcacgtgccagctccaacgtatcttttttaaaaaaatccgccggtaaaggcataagcaacggggtttttctcacctgaatgcctcctttctatctggggcgctactttccgtacagtcatgatacccggcaaagggcactttaactccatatcctatagtatccagccaaaaagcatctttccgtgcagtaaaggatctttcatgcgcttaaacatgcatttttcgacagcggtttcgccgagcataagcgaaaaccggaatgaacactctttctatgcaatgaacgtttgacatcgcgaacgcttcgaaggcccctttcttcccacccattctgaagccggagacaaaaacatctttccattcagcaatggttccttcgtatttttaaacataccttgccacgataacggttacgtgcaatacgaacggaaaccggaatgaaaatctttcccatgaaatggcaacaatggatatcccgcacgcttttaaaaaaacccccaccaccgataacggctacgctgctgcgattgcggaatccggaaccaaacgcatctttccatccagcaatggttccttcgttttaaaacctatacaccgttcccttattataaaccgaaatggaaaaatgttctccattcaaagcttcctttgcacattcaaaaaatggatcttccctgccacgataacggttacgttacagcagttaccagagacggggaaaaggcatccatctcaattcaatgataacgattgatatccctttttccgctttgttcgaggcgtgcgactaatgcggttaaaatgtatttcacataagccagcacactcgaacggcgctcgcggatgatgttaagctgttggataaaatcgagtatactttccctgctcatattgcggacaagcaaatcgattgcttgctcgattgtcaattcccggtgcctgtctttgcttgtctgcacttcaatcgattcaaacgaatgcatgaaagagtggagaattcctctgatttgattctcactcaacggaattttttttaaatcttcacttgatgttttgctcaatttcaaactcaaatcctttctacacgactatgcagatgccgggctgcacgctctgtatctttttttgcattgccacagcagcgcccccccttccccctttatgcaatacggatttgaaacgattaaaaacgggatgatgaaaatttttcacatttgcctattttattattataaccgcaaaggaaggaagcattatagagcgtaaaacggaaatgatactttcagactagttcttgccgaaaaattataataaaggcgggctctctttgcccgccagattacattattgtttcgtttcttttacagattcatacattttttgaaaacgggcttccacttttgcaaaaatggtgccgtccgggaagcggtctcctgaagtgcgttctgctcccgcgctttcgccggttaaaatttcaatcccttccgaaatatggcgaacagcccatatgtggaattggccggctttcacggcatccacgacttcatcatgcagcatcaaattgcaaatattttgctgcggaataatgacgccctggcgccctgtcagcccgcgatctttgcaaatggcgaaaaagccttctattttttcatttacaccgccgatcggttgaatctcgccccactggttcactgaaccggtaacggcaatgccctgtttgatcggtactccggcaagcgatgaaagaagcacatacaattcggtactggaagcgctgtccccgtcaataagcgaatacgtctgttcaaatgtgatgcttgccgaaagcgggatcggcttgttttttgcaaacatgccggataaaaatccggttaaaatgagcagccctttgttatgaatctgtccgcttaaagaggtttcccgttcaatgttcataatgccgcttttcccgacaaacgtttgcgccgtgatttttgtcggaatgccgaatgtcgcatcccttgtccccatcacagccaggccgttaatttggcctacccgttcgccgtccgtatccaccataatcgtcccgttatggatcatttcgcggtattgttcggaaatatggttcgtccggtttgcctgctcttccagcgctttgcggatatgatggctgtctacgcaggcgcttccttcttttttcgcccagtaacctgattcgacgagaatttttgtcaggtcctggaagcgcgctgtcagtttctcctgttccccggcaaggcgcgcactgtggtcaatgactttcgcaacggcgcgccggtggaacgggagaaggtttttccgatctgcataatttttgataaaataagccattttcctgcggttttccgcatcccgcttcatcaccgtgtcaaactcgactttcactttaaacagcttatggaaatcttcatccacgcttgataacaaatcgtataaatagtaagacccgataatgatcactttgatattgagcgggacaggctcaggcttaaggccgctcgtcgggaaagcgcctctttcagcaaacgggtcttcaatctggattttccccgtttgcaacgcgcgttttaaaagggtccatgcatacggctgcgacagcagttcggcagcctgcaaaattaaatagcccccgttcgccatatggattgcgcccggtttaacgagcgtgaaattggtcgtccagctgccgaacgcgccgcggtactcgattttcccgaataagttttggtatgtcgggttcgtttcatagatgacaggcgcgccctggacgtttttatggctgacaaggagattgacggcatagcgctggagctgctgctctttgctgccggtcagcgcctggacgacggtgtttccttcttcctggtcggttaaaaacagcgaaaaatgctcgacaacatcatggttgtattcttcgagatagctgaggacttttggaaaatcgcggtaagcttcttttagcggctggaacaggccttcaatggtaaaagcagctgtctctttatgaaaacggtcgagatttttccggagctgttcttcaattttccggatctggtacaccgtttcattgattttttcctcaagctgtttttcccgttctttcaatttttctttgttggcatcggaaagccgctcgtattcttctttttccatcggccggccgaaaaaaagcggaatggtttgaatgccggccggggtccgctccaatttaaaattcagcccggacgcgaacatttccgtttctctccaaagtgcctcgacctggttttgcgacgcgtcaatgatattccgcttcttcttttccgtttcttcatttgaaaaagtggcgcggagttcccgttcaatatcaatcaaaagggtttccatcttgcgctgaaaacggaggccgcttccagccggcaaattgatgacaagcggccggtccggattttcaaaattgttgacatagcaccagtcatccggcaccggccgtccggatgcgagcttttcgacactatgttgcgtatacgtcattctgcccgtcccggacggcccgacgacgaataaattgtaaccggactgctcgacagacaaaccgaaatccatcgcctgttccgcccgctgttgcccgatcatttcattcggcagcgtttctaaatcatctgtcgtttcaaacggaaactcgtccgggttgcattccgaacgtaatgatgagacaggtacacgatgtacggataaaaccgtttcgtattcttcccgattcattgcaatccctcccaatatgggcaatgcccttcccgtaagatttcgacatttttgtcggaattcctgcaaaatggcggcatgtcaaaaagtgaacatttttaaaacggatcgaaacaggaacacgcaggaacgagatccgggcaggttttccgattgccgccatggtttcggatggcggatccaagggtatactacagaaaaaaggaagtgtgaaacatgtccgataaacagttgaaaaatgaagaagaaaatgaaaagaagaaaacgaagaagctggctgacaaaacactgacagacgggacaatggacaggaaggaagagaaagaggagtaagaatattgcaagcaacggaaacggcttgatcgggatccggttaagtggcagcgtaaccatcgatagatatagcagctaaaaagaggaagcattggggtaaacatgcttcctcttttttcttccgacctttgtcataggtgatcaccatttcggatttcttttttcttctattctttaagcctctccctctttcccactctttgatttcgtgaatacttcctgctcattcatcgcccatttctccagttcctgcaaaatgtccgtgccaatcgtctttttccggtaatccgcagcagaaagcatcatcagccacggataggctgataggctgccggcggtatcgcttttatccttcgtctatattgttcccacgttgacctgaactttgtccaaatcaaatgtatggaattccagatgcgggctccaagtgaatgtccagtttcttcattctaacatcggaatctgctccgccggtcaaaagtgccggaaatggaatatcaaatataaaaaggaggccctggaaaaggcctccttggctaaacctaaaattaacgcaacaattgcaatacttgctgtggctgctggttggcttgagccagcatcgcttgtgctgcttgggcaaggatcgattgcttcgtttgttcagacatttctttcgccatgtcgacatcacgaatacgtgattcagcagaagtcaggttttctgacgaagtggtcaggttgttgacggtgtggtctaagcggttttcaaaagcacctaatttagagcgttgagtagatacttgattaatggctttttcaataacatcaattgattcgcgggcgttatccgcattgcttacatctacatcggcaattgaccatgttggatgcgtatcagaaccactaattccgagtgcatcagcctgcatgttatcgattgtaacattaagtttttgctcggcttcgttgtttgcgccaatttgaaaatctacaccagaagcagcaacagtaattgtttgattattagttttagcaacaccagcgttcaaaccgctattcacttctaatgtaatcccaaaagcatcaaatgttacgttacttgattgtccggcagctggatttgcgattgcactaattgtttgtgattttccaccactcgtgatcgtgatatcagttttactattatcaccactattttgagcaacagttaaagtatatgttgcaggtgcagtaccatttgttttaacagcattaataccatttgcaactgttaaatcagttccaagagcaactttatttcctagtgttccatcaagtaaattttttccattgaattgtgtagattttccaatacgggttacttcagtctttagagaatccagctcttcttgaattgcatccctatccacatcttcatttgtatcatttgcgccttgaacagccagttcacgcatacgttgaaggatatcgtgggtttcattcaatgctccctcagctgtttggagtaatgaaattccatcttgtgcattacgagttgcttggtccaaaccacgaatttgtccacgcattttttcagaaattgctagacctgcagcatcatctgcagcactgttaatacgaagccctgaagacagtttttgcatggcttttgattgcgcgttggttgcagcatttaagtggttcaacgtgttcaacgctgcaatgttgtgattgataatcatctatgtttcctccttgaatgttgtgcacccacatccttgtgggcgaaatttttcaacggggtccgaggtcggccgccctgttcccccgctcactctttatatcggatggggaaacatttgatttaatagttttaaagaaattttttcgtgcggattggtttttgagggactgggaagtgcggatactgttgtcttggggaggatttcccgttgtgtgcagtaacaggttcaaaaatatactggggcctgttgctgcctgccctgccgcccgcagcatttcttatatttttccccgcttccgcacgagcatgcctgcactaaaatttgcccacccgtttttcaagcccgattccctccaaaaaagcccggcaccgtattgaaaatcaaaaaagtaccgctaaccaatgtgtccccggactttttttaactgcccatatcacgcgcccccgctgcctttcttggattgggcaagcagatggagcaggccttcaatattttttgcggcgttcgcgttttcttcctgtatgtccaagtacacttctttccggtgaatttcaacatgtttcggggcgttgatgccgattttgacctggtcgccgtggatcgcggcgatggtgatttcaatgtcatcgccgatttggatcgactcgccttttttccgcgataaaatcagcatcttctcaccccttttccttgcccggcccgtccgcaaagagcgggtgccttgtgtgatagtgccggtcgtttaaaatcagttgtttcgccttatgattcttttcgttcataatgagcggggcctgcaaattggctgttgtttccgaaaacggatcacggaccgtcaaaatggcataaacccgcacatcttcctctttttcaatcgacagctgttcaagcgtggcatcatcaatgttaaatgcataatcccgaaaaaacaaaaacgggcttgtgacgacaaaagcgacatagggtgacgccgttgactggaggaccatgtaaatgccgtcgtccaaaagcggcagcaaaacgaaggatttctcatccggaaatcccggaatcccgccttcaaaatgccatatagctgcatcctctatttccacttcgccgtggtattttgtatgaagcttcatcatgttttgcgaggggtccccggcttttgctgccggggaaaaccgccttctctcctttcgatgggcatattcttttgcgttttctaacccttgcggaggcatgcatttttctgctgctaaccggcgttccgctcctgccccgcccggtttaaaaacattcagataaaaaaacggcaccacctggcaaagcagggtggtgtccccgtattatttcaaaaagtcgagcaatgtcggctggatcacttgtgcgccgacttttaacgcagcaatataggcgccggatgcaacggaaaagtccgtgtacgccttatcgatatccacatcttcgtttccggccatgatcttcgttgccgttgtttcctgctgggtgacgcggtctttcatcaaatcaaggcggttgctccgcgccccggcctgcgacagttcgctcagcacattgtcaatatggccgtcaattttgcccaaatagctgtcaaagccgcttgccgatgtgccggattttaaatcgctgattaaatggttcaggtctttaaacagatcatcagaaaaagcatttgctccgttcgcattgacttgcagataaatgccatttgacagttcgatttttaccggattggtgttcatgccgaggctggttgagccgtcaaacgtgctgatatcgccactgatcggcttctccgtcgtccgggtgccgttaaaaatatatttgtcattgactttcgtattggcaatattgacaagctgatcgcgaagttgttccacttcatcggcgatcgactgcctgtcagtcggagtcttcgtgtccgttgccccttccactgtcagttcccggatccgctgcaacacctgattggcttcatcaagagcgtcatttgtcgattcaatccaagtgctggcttccgcgaagttgtcttcgtattgcttcacctgggcgacggttctccggtaggaaatgcctttcatcgcggacagcgggtcatccgaaagtttgttgatctttttgccggaagacagctgttcctggtatttcgcgagtttactatagcttgtgtttaaattgtttaagaaattattggcgagcatcgattgggttacacgcatcgtttttcacctgcctatctgcctacaacacccatgccgttgatgattttatcgagcatttcgtctgtcatagtaatcatccttgctgcagcattataggcttgttggtatttgatcatattggttaattcctcatcaaccgataccgagctgacggacttccggttcatatccaccgaatccaaaagggaagcggtatttgtctgcatattgcctgcctgttcggcatcaaccccgagctttccaatgaggccttcgtaattgctggtgatggtgccggatgcaagcggcagaccgagtgccgcaatgttaagcctgccactgatcccttcaagctgcacggattggctgcttaaatcaaaggtaaccacatttgcaagattaatggcattcagcccgtcgccggaatcgccatttgaagaggcggcgattttgtcgtatgtaaggctgctgttgacggcaatttgacccgcggcccctttgtagtccgttaaggtaccgaacgtaaaaaaggcagtcccggcattccctttaaggtctgtccctttttcgtggacagcatttaatacgtttccgaatgtgtaggcgagtttgtccaggctgtcgagcaaactcggataagcccctgcttccactgtgccgtttgcgccggcatactgataaccgtagctgtcaatcagtcccaacagtttgccttgcgggaacgtgaccttgccggttgtatccgcgatcgcaaaattttttccgccgattgtgatgccggccatctccccgtttgccggcggcccgtcgaggatgccgtcgctgttgctgtcggtgcccccttgcacttcgactgcattgtaatttgaaccttggacaaggtatacgcttgtgccgtccgcagcagccattttaatgttgtaaatgccgtccgcatttgcttttgcatttccaccgcttttttggacttcgacggttacgttcaaataattggacaacttatcaacaaggctgtcccgcttgtcatacaagtcgtttggcaaataaccgttcggctccaggacagcgatctgttggtttaagtcgctgatctgttttaaagtggaattgatatcgttgaccgatacgctgatttcgctgccaacatccgttttgtactgggaaagcgtgctgtttaaatagtggaacgtatccgtcagcgtctgcccgcgttccaaaacaaccgagcgagcagatacgtcttctggattcgtgcttaagtcctgaagggattcccagaacgcttccattgtgttggacaaactgcttttcgttcccgtttcatccatgacggcttccattttgcttaatgcaccagatttggctgaccagtaacccgctgcactgttgttttcccggtattggacatcgagatacttgtcgcggatccgctgcacttcgcccgcttccacccctgtcccgagctgtccggcgatggccgggcggttcatcgaagcagcggggtacggatctgacgcctgcaagtttacccgctgccttgtgtagccatcggtattggcattggccacgttctgcccgacggtgtacagggcattctgttgggccgtcaaagcccgttttgctgtttctaatccaaagaaagtggacaccttgcttctcctccgtattctttcaggcttttgagtcgaaccgcggcatggcggccgccgctttttgcccggacggcggcccgtatgtggtgggttcatttttcggataaatcagatccagcatgaattgggtaaattgaagggaatgataaaggagcatctggttcagctcattttgctgtttcagcttctttgtgatgccaatcaggctgtccctcaatgtttcgagctgggaccgtgcttcccccgatacggccgcgatgcagtccgacagcgtcccattgccgccggtaagcgtctttgccagcgtttcccgttcctgttcaagtgcgccgattgcacggatatgggcctgttcttcctgcgtaattttttgcagccgttctatctcctgctttttcaccgcttcggttttttcggtggcaaggataaacaggctttcatggagcttctgcaatttttcaagacatcggatcaatttttccgcagccatttacgcccctccttacttgcctgtaaaatatttcaaaatgccttcagcggttttttccgcatccggctgataggttccgtgctgtacctgttgttttaaagcctcaattttccggctccgttcctgctcaaactgggacgttttttgcaactgtttcgcttctgaagaaatttccactttatccgttttccgggtgctggaggcggtttgctgcacatcccgcctggcttgctgctgatacggattgatccctgaagtattgaccggattgattttcattcggctcacccctttttcaaacagtatccgttccattatgtttattatatcggataaagctgcgcaatgtttacttgatgtgataagtctttttccttatttcttcctgccgtttcttttctttttcaaaacgttcaagatcttttgcaatcgtttttgcacattcttcgcataactttccggactggattaattttccgcaacggtcgcaaggatatgccagattcggaaaatgcgcaatcaaaagccggccgctccgcacccatttgaaaaccagtttttccgggacattgtttttttcaacaattgtctcgattgttgccgcacggttttcgcgtttccgcaagaattgaaaaacccgttcaaatgcagcttcttcctcgcgataacagtcttcacacacatcgcggacggaatttttgacatataatttaccgcaattcgggcagtttgccaactccgccattcggcccgcctccttttccggcacatttgtcttctatcttctatatcggcagaaatttcgttgtgtttaacttctcgccacagttaacgatacaatttttcgggcgcccgcttcacgcaacacttttgctgcatggcggacggttgaacccgtcgtgtagatatcatccaccagtaaaacggaacggccttcgattgaaacttctttttccatataaaaagtttgggcttgatgaatgcggtcagcccgtgtttttttcgattgcttttcagcgtggacgcggtgaagaatgtttgccgtttcgagcccggcagcacgggcgagcgcctccgcctggttaaaaagccgttcggaaaggcgctccgggctgagtgggaccggcacgatgcagtcaaatgtgcgggacttaagcacctctttgatgccatccgcaaaaatggcggcaagcgcataatccccgcgaaatttgaaacgggtaaaaatttctttacaaaaatcgttgtacgtataaagcgaaatgttttcatccagcacgcccgcccattccgggtcttgttcccatctggcacagtcaagacacagagctccctccacataagaagcatccaacttggccaggggtcgggaacatttcgggcagacaggcggtgtaattttttcaagctgcgcgcggcaatcttcgcaaagaagtggtccgggctgcggaaaaatcagcgtgcgccaggacagtttatgggtaagcggctgatggcagaacaggcaatattcatgcatcgagcaacccccgctttcccgcttcttcattcatggagagaatatggcgctgtgctttcaccatcgcatttgattttccgtaatggaaaaacgtcacgtccccacttgggaaatcggcgcttcttccggctcggcccgcgatctggacgagggcagcttccgtaaagatagcatcttccgccccgacgacacagacatcaatattcggaaacgtgacgccgcgttcaagaatggtcgttgttagcaaaagcggcgttttgccggcgcgcatcctttccactttttctttccgatccgggtcttctgcgtgcaccgattcaatcgctggatgcagctgtttaaaaaccggctctgcttttttcatgaggcggatgttcgggagaaaaagaagcgcctgttttccggattcaagcctcttttttacccatgcttcaaccggaaccgggagcttgcctttctcaaacttttttcgccagttgcctgcccatttgaatacaggaacagggaggggcttgcggtgatagcgggccgggatcgtgacaaacgggcgcttacctgtcttgcattcaagctgccatgtttcacttggtgttgcggtaagataaatgcgggcgcagcggtcttttgccgctttttgaacggcgcactgcagcgtttcatcgaaagtatacggaaaagcgtccacttcatctacaatcacgacatcaaaggcggatgcaaagcggtacagctggtgggtagtggagatgacgagctgcgcccatttatggcggtcagggctgccgccgtagagcgcggcaatcggaatatccgggaaaacgcggcggaagcggggggcaagttcaaggacgacatctgttctgggggttgcgatgcagacgcgttcgccgtttgcaagcgccgcttcaatccctttgaaaacgatctctgtcttccctgatccgcaaacagcccaaatcaagagctcgtttttttgaagaatggctgctttaaccgcttcggatgcagcctgctgcccttcagaaagggtgccatcccaatggagcgggtgcctgggcgagtggaatgcgggcgcagggcctgcccatgtgataagcggcttgcatgcggtgacccgccccatcatcaggcagttccggcaataaatgctcgttttcccgcagtgggcgcaagggaattcggcaaaaagatgcggcgcgcggttgccgcagcgcaagcagacacagtgcgggaattcgccctgtatcgccggctcagcgcggatccagccttgtttaaagtgctgatcaagcagttccggtgaaaaagggatttccggttcgaacaggatccgtccggcgaggtggcgttgaagctgttcggagaaaacagaaggcaaagtgatcactcctttgtcaattgcgggggaggtgggcaaatggggcggcccggttccaaacggattcgggaaaaagcctgtacggatgcatggattacaactgcttattcaatcgcggattggccggcggggtttagggcttgtcccggggaggatacgcttaatcgctaaaatcctcaaaaggtattggctgtccggcaggtttcaaggcttatccccgggcctgttatgccaggtttatcccggacgatcccatcttgccgggctgttccagcgatttggaacagcctggctcttatttcagcatccaggcaacgccgatcgcgccttcgccaaggtgggtggcgatgaccgggccgaagtagctgaccgaaaaatcgacgtttggaaaccgtttttccagttcatctttgatttcaagcgcctgttcttcccggttagcatggataatggagcatttcagcggcaagcctttggcggcatcctcgctgagcaggtcaaaaatccggttgagcgcttttttctgggtgcggattttttcaaacgggacaatttcatcgtcgacaaaagttaaaagcggcttgatttttaacaggctgccaataacggcctgcgatccggacagccttccgccgcgctgaaggtgggtgagatcatcgaccatgaagtaggctttcgtggatgcttttaattcatcgaggcgggcgaggatgtcttccggttcttttccggcaagcgccattttcgccgcatcaatcgcgtaaaatccctgtgccatgcagctccatccggaattgtaagggtaaactttgatcccttccaccatcccggaagcggccacggcaccctggtatgtcccgctgatttttttggacaagtggatgctgattgcggcatcgtagtcttttttaagctgttcaaacagttcgacaaactggccgattgacggctgcgaggatgtcgggagctcgtccgccatgcgcattttttcaaaaaacgcctctgctgtaatgtcaatttcttcgcggtattcttccttcccgaaaatcacattcaatggaatcatgtaaatcgagtatttttcgcgtacttcttttggaatataagcggtactgtcggtcacaatggccgtcctcatttttccatctcccttccgctttactatttttattttatagaatcaggaaccgtttgtcagccgtcttctttctgcgcaatatggaaatctgttttgtggctggtgttttttgccaaatcccccaattctcctgcaagtgtgtaaaatgctatttcaatcctgccgtagattcccttcactgcaaaaatttccttttcacttcaagatttcgcaaatgatacaaaattgtaaataataccaggtccggaagccaaaaaaggaagaatccgtatggttcagcatacaatcattcacttgatggcgctttctttaacggaaaaataaatcttttccagaaaacgttcgtgttttcgcctttttcaaaacttaattttctgttttatctgtcctttacaaatcatgtcatattttgtagaatgtctaaggtaactcaaatggtgcatgcaactcagagacaaaaggtgtatcgttcagatttaaaatatttgaaaattctccgttggcaaaattattggatcacatcttcatcactgggttggctgcaaatagaaggagattttcgacatggaattattcaggaaaaaatcaatggattacatgcttaagcaggcccgcggaaaaaagagcctgcaaaaagcccttggcccctttgatttgaccatgcttggcgtgggggcggtcatcggaacaggcatttttgttttgaccggtattgttgctgcgcaggcggcaggcccggcaatcattctgtcctttattttttcagggattgcctgtgcgttaacagctttatgctatgctgaattcgcttctatgatccctgcttcaggaagtgcgtacacttatagttatgcaacgtttggcgagttgtttgcctgggtgctcggatgggacttaattctcgaatacggcctggcctgttcagttgtagcgagcggctggtccgcctatttccaggatctggtacgcggatttggcatccatttgccgcaggctttaagcggcgcttataatccggccaaaggttcgtatattgacctgatggctgtagtgatcgtgttcttcctgtctgctgtattgctgaccggcgtgaaggaatcgagcaaaatcaataatgtcatggtctgtattaaaatcggcgtcattcttttattcctcgctgtcggcattttttatgtcaaaccagcgaactggacgccatttatgccttatggctttagcggcatcattaaaggggcggcaaccgcattcctcgcttatatcggatttgatgccgtttcgtctgcggctgaagaggtccgcaacccacagcgggatatgccgatcggaattatttcttctcttgcgatttgcattgtcctttatgtcgctgtatctgcagtgctgaccgggatgattccgtatgccaagctgaatgtcggcgatccggttgcgtttgcgctccgggttgtccatcagaattgggtggcaggctttgtttcactcggtgcaattcttggcattacaaccgttctctttgtcatgatgtacgggcagacgcgccttttctttgcgatcagccgcgacggtctgcttccaaaatcgatctcaaaactgacggaaaagacaaaaacgccgacaagaagcatcatcttgacatggctgatggcaacggttttctcagccgttgtcccgctgaaccagcttgcagaattgaccaatatcggcactttgtttgcttttattgttgtctcgatcagtgtcattgtgctcagaaaaacacggccggacatcccgcgcagttttaaaacgccgttcgtcccggttattccggtgctggcagtaatcgcgtgtggttatttaatggtccacctttcgaaagtgacctggattggctttctcatatggttcatcatcgggcttgccatttatttcggatacgggtaccggcacagtgaactcgggcattggaaagatgacagaacaccggctgatccggttaaaaattgaaatagggagacaacaggaacacctgcccagcggacaaaagaacgcctgcatggcaatgccgggcaggtatccggacaggcttacaaatagaagaacagcggcttatgggcgcctcaaaaagcattgctgccccggcttggccgcataatggaaaattgaagcagacataaagccaaaaaaaagattcccgggtgcacgcgtacgcccgggaatctttttctatcctgaaaattgcacttgatgattttcatttctgcgccggtgttgaaagccttggcatacacaagtgtacggccaaggccttgttttagcggacttcaacccacccgtttttaatggcggtcaccaccgcctgggtacggtctttcacttttaatttttgcaaaatattgcttacatggtttttcactgttttttcacttatgtataaagcatctccgatcgcccggttgctttttccgtccgcgagcagctgcagaacctcgcattcgcgcggcgtgagcaaatgtagcggcgggacaactgccggtggctgctggtaggcgccccccggtgtatagcggttcgacaatttgcggaactcctccacgagattgtgggtgattttcgggtgcaggtaactgccgccttcagcaactacctttacggcttcaatcagcgcatcggaatccatttctttcagcaaataaccggttgcgcctgattttaatgcatgtgtgacatacgattcatcatcgtgaatggaaagaataataatttttgtttccggatatgcctcgatcagctttcttgttgcctctaccccgttttggtgtggcatattgatatccatcagaacaacatccggatggtatttttcaataatgtccagcgcctcttcgccgtcttcaccctcggctaccacttcaaatgttttttcaaattccaaaatccgcttgacgccctctcggaacaactggtggtcgtcaataatcgcaatttttaccgtcatggtcaccttttctccttttccaagtctaattgcatcgggatttggataatcaccaatgttcccgctcctatttttgaatgaatggaaatttcaccatttaaaaggctgacgcgttctctcatgccgacaatcccgaaagccccttcgcggattctgcggatatcaaaaccgacgccattgtctttgactgtcgcgataaaactgtttttcctcaactccgatttcacctggatttccgtcgccttcgcatgctttaacgcattttggacggattcctggatgaggcggaaaagcgcgatttcataattggttggaagccttcgttcttccccgagatgcctgtatgtaatgaccggacttcctttatagctttcaatcgtagacaaatattttttgagcgtcggaattagcccgagatcgtctaatgccatcggccgcaaatcgtaaataatgcgccgcacttctttcaatgaatcgcgcaccagttcttttaacgtgcgcatttcagcaatggcttcttccattccattttcatgataaactttttccactaggtcggaacggagcagcatattggccagcatttgtgcgggcccgtcatgtatctcccgggaaatacgcttccgttcttcctcctgcgcttcaatgacacgcaaaccgaattcctgtttatgctttgcatcttcaatcgcctcgctgatgctttgcaagtcgcttgttaaataatttaatacgaccgttgtttgcgagacgagatgattggcccggtcaatcgtatcctttagtgaatgcagcctgcgttccagttcatttcttctttcgcgcagctgaagttcgcgctgccggttcatggacagctgaatttggatcgtatgtgccttttcatatgcttcgcgcacctgctgttcggaaaagtcacggaaatgctggcttacttccgccaggcgtcgccttgcaaatttggacttcgtttccagctcatctgtctgctcaataactttagccactgttgctttgacttcctcaagctcattgatgagcgcatcgtaatcctggcggcatctttctccaatttcaaaaatttcgtgtttgctttcttcaactgttgtaatcatcttctccaggatcgtatccaatactttggagtcgaatgttttaaaagtcatcttacttcccccaaaaggtataataaaggcttatccgagagcagggcaagccgcagcacacacgcggctaatgttattttaacgcgaaaaccgccggtaaacgatcagaaaataaagtataaccgtatatcaggactattttcctaggtacttttgtaggaaaatgtgaaccgatatacggcagcttcgacatattcttatatattaaaattataccatacaaaaccgtgttataatgagggaaaaacaggttttgctaaaggaaggttgcaatgttaaaagaatattatacagtcaaaggcgaggctgtgcatgaaatagatatccagaaatcacggtttatcgcccatgtgaagcgagcggaatcggaagaggaggcgctcagttttatcgcttctgtgaaaaagaagcaccgggacgccaatcacaactgttccgcttatatgatcggtgagcagaatctcattcagaaagcatcggatgacggcgaaccggccggaactgcgggcgttccgatgctggaagtgctgaaaaagaaggatttgaaggatacggcagtcgtggtgacgcgctatttcggcgggattaaactcggagccggcggattgatccgtgcgtacagcaaagcagcttcagaaggcatcaacgcatgcggcatcgtcaaaaggacgcttaccgccactttccatgtcaaactggattatacgtggctcgggaaagtcgagaatgcgctacaccattccccatatgaaataaaagaaatccggtatctcgcgcaggtggaattggatatttatgtaaaagaaggggaacagcatgcttttgaaacgtggatctctgatttaacaaacgggcaggcggatgtggccgagggggaaaaactatatttggaaacggatgttgcccggtaaagagaagcataaaaatcggaaaagcagaagcggaaagcccgtcatccggctttctgcttttttaaaccggaagcggacgaacaggtatcaatccaacacggcacgcaaaacagccgctgagccggatacaaccggccgtgagcaggagatgctgaaatctcagccagattgccgttaaaactgggacttgcaaaacaggtttacagccggccggaacctcatcatcgttgcagttaacggagctgccaaagtcgcaaacctgaaactgccagttgcggttttgtgcaggtgctgccccggattatttatttcgggaacggcccaggtggatccggacggctatgaccggttttttataaaattcaacagtggcttgtaatcttttccgatcaggccaatgctttcaacgaaaatctcaattgtaatcaggatcacaccgataaaaatgagcgagccccaaagcgtcgccatcgagaagataaaggcggcgaggctgaacatggcagcaatcgcataaataatcagcacgacttggcggtgtgaaaagccgaggcgcaagaggcaatggtgcaaatgcgacttatctggagccgataaaggctgcttatggacaagccggcggataattgcaaagaaagtatccgaaatcggcacaccgagaataagcgccggaataatcaaggaaataaaggttacatttttaaagccgagcaatgacagcacggaaatcatgtagccgagaaaaagcgcgccggtatcgcccataaaaatctttgccggataaaaattataaaataagaacgcaatcgtactggccatcaaaatcaggccgagcaccgtcacataggcgtcccccataatgatcgccatgccggaaatcgtcagcagcgcaatcgaggaaacccccgcagccagcccatccaatccgtcaattaagttgatggcattcgtgacgccgacaatccacaaaatcgtcagcgggatgctgaaaatcccaaattccagctgtccgccgaaaggaagattgatgaattcgacatgaatgccgcttaaaatgacaaccagtgcggctgccagctggcccatgagtttgacgcgcggcgacagctctcttatatcatcaatgatgcccgttaaaacaataatcaagctgccgagcaaaataggcagcgaatgcgaactgtccggttgaagcagcagcacgccggcgataaaactgatataaatagcaagaccgcctaaacggggcatgactttcatatgaacttttcgctgattcggcttgtcaactgccccgatccggatcgccagttttttaatcagcggcgtcaggagtattgtgagcataaagcatataaacaaggtcaggaatatcaatgtgctgcctcctttggttgatcataaccaataaggattgaagtgttcgtgaacccgccatcgatgccgaagcatgataaccgtttcacttcttcttaaaaacattataccttaactttcttaaagcaatcttaaaaaaatatttacccgaaattcactgtaaccattataattgttctccgacaatttatccactaacatttgagcgattctactatttttcatgctttttctcgcagcaaccgccaaaaaacatgaaaaaggcatccccggtcactttgacatcagggatacctttaagatacaaaaatcgcattgtttaagtggccggcatcagcaaacaaatctttttggcggctggacaaccggcatccatgccgctccccgggatgccgccttttcacgctatataaaatgagctttggttttcccatccgaatggatcgttataaagaacgcagtcttcttatctcatcccgcgtcacaaattttatttcaatttatatagcatgaagctttaaccttttttgcagcggggatggcccttgcaaagttaactattgaaacagatttacggctttgttcacgacaagcccgctgccgccgcgatgtttaacattttcaatcatcatcgcaacaagcatattcgggttcttttcgtcatatacgacgaaaaagccgttttctttgccgttttgatctttttggctctttttcagttcagcggtgcccgttttccccgcaagctgcgctccggagatattggcagcgtgcgccgtgccggacggatccgcaacgacctggcggagcataccggaaatctccccggtggttttactgcttgcggcatgtttccacacttttgttttttcacctgcaagcaaatttggcttcagttcatcgccgctgtttaaaaacggcgtgtagctgatggcgagatggagaatattcatttgcatctgcccctggccataacccgtgtctgcaagctggatgtcactgctgaacttgccggtggacgaaatttgcgatgccttcaacggatacgcaaacggaatgtcttccccgaatccgaaacccttcaggccctttgcaaatttgtccgccccgatatcaagcgcggtttgggcaaaaaagatattatcggataacacgagcgctttttccatgttttccgggctgttattggcgtggacgcgggtcactttatagctgccccagtcggcgttcttttgccacgaagtccctgtgatggttttcgttgccgcggttgttgtcgtcccggtatcaagcgcgatagccgcagtgaccggcttgattgttgaacccggcgcatacgttagggcaaaccggttaatgagcggcttatccggatctttttcaagtttcgtgtaagcggaagaagacatgcctgaaataaaatcatttgggtcgaaagcaggcgtgcttacaagggcaagcacgtcacccgttttgggatggatggccgcggccgtgccggcatcccccttcatttgattgtaaattttctgttgcaattcggcatcgatggtgactttgatattctcgccgtttttcactttttgctcagcaacggtataggtgctgccgtcctgcttctcgatgtaaattttttctcctgcctggccgcggagcttttggtcatacaactgttcgagcccgcgcttgccgattacactctccgcagtatagcccttcttttgcagttttttcagttcttcgccagtgatcgcaccgatataaccggttaaatgcgcagcggcttttccataaggataaacgcgggcaccaaccgtttgcgaagaaaagcccgggatggaggtgacttttttcacgagatccttcttctccatcgggactttttttaacgggacaaacaaatgaggctgcacccagtcctcgtccagtttttgtttgatttcgtccgctgacatgccaagtaagccggcagctttttgcatatccgcttgtttatcccctttcaattgttccggaatgacgccgatttggtacacgctgccgtttttggccaacgcttttccgtttcggtccaaaatttccccgcggacagcgttttggtcggacactttaatcgtatcccctttggccaaatgcgggagaataagatccggcttccaattgacataccagttttcttttttgtcccgtttttcctttacaagcgccactttatccttgtagacgactttgccggctgaggtttggaacgaaattttgaccggcacggtaactttctctttgtttttataggcatctttatccaacgattggtatgaaacatttaaatctgaaacattcaagtccccgtacacttttttgtaccggtccgccatatcttttttcgcatacgttttttttgcggaagccgataaataactatggtacatttccgcaaatttttcctgcttccatgcttttacataatctgcaaggcgttcattcggtgtcggcgttttttcgcaaccggcaagggccgccaaaaccccgagcagcaaaccgatgataaatacatacttcctcaaaaaatctcctccctgacaccggcaagtttccaccttttgagaaaaaaatggagaagtttgccggtttttgtgttacatttgtgttagataagaagaactagatttggaggtaagaacgtggacatcattacacagttaaaagcagacaacatgcgcaaaaaaagtcttctcatgtttattaccctgcttgttgccctgctggtcgtttttgtaacatatctttacaaacaagaggccggaatggctgtcctgtacggcgtggaaatcgttgttcttctggcactgtattttacactcgggcgcgccatgaaaaaattccgcttgttttcttatgcgagcgtcatcatttcttatttgttcagaatatatgccaccctttttgttcaaaacagcttttccgtagacattttgtttttctttctgcttgcttatgcggcattgcagtttgaaaatgtccttttctttatcggagccggtcttggcattgccggatttcttgccagctacttggtgccggccgccgattcgggcctcattcataacctggtcccgaccgctttgctctgctatgttttaaccgcaattttattatacgccatgatctacctgcatcaaaatttgatggattcttttcttttatccataaagaaaacccttcaaaccatggaagatcaaggttcggcttaccggcaggaaatggcggagattcttgaccgcgtttccaatgtgaacgacaatatccagaccaatttgcacgcccagaacgaaatgaaatccgccgttcatgaaatctctaaaggcagtgtaacccaaagtgagcagattgcgcaaattgccggacacgccggggatacggtgcaatcgatggaatttttaacacaaatgtccggtgaactgacaaacgaatcacttgaagcacaggaaacggcaaaagccggggaaaaggcggtggaaaatttaacgcttgaaatcagtgatgtggtagatacgataatggagctgaacaacacatttacagtgttaacgcaaaaagtggaagaaacgaatacgtttaccgacagcatcaaacaaattacggaacagacgaacctgcttgcgctgaatgcttcgattgaagcggcccgcgctggggaagcaggccgcgggttttcgattgttgccgatgaaatccggcgccttgcggaaacgacacacgagacaaccgaaaaaattaaccataatttggctgatttgaatcaaagcaacgcggcggcacgggataagctggaattaagcagcacgcaaattttgacgacagcggaatcaagccaaaatgtaacgacctatttccgtaaactattaaaaactttaaacgggcaggttgagaagtttaaagaattcgatacgttatccaaaaaagtgaccgaaaaggcgcatggcgtggaaggcgcatcaagcgaactcgcggccatcattcaagaaacctctgccagcctggaagaaatgtcagccacgattgaaagcttaacgaatgaccaccatacgatcgcagaaacgctcaacgaagcggctgtccaggcggagcagttccgggcaaaaaccgaaaaaatgcagaaaaagtttgccgatcaaatcatttagcagacggatatcttaacatagacgcactctaggttaaggaagaccctcgattttgccgggtatcttaacatagaacgcttctatgttaaggaagacgcggaatttttacgggtatctgaacgtagtcgcgctctaggttaagaaagaccttcgattttgccggatatcttaacatagaagcactctacgttaaggaagacgcggaatttttatggatatcttaacgtagacgtgctctatgttaagaaagactctcaattttgccgggtatcttaacgtagacgcactctatgttaaggaagcgagaaaatttttgcggatatcttaacgtagtcgcgctctaggttaagggagaccctcggttttgccgggtatcttaacatagaacgcttctacgttaaggaagacgcggaatttttatggatatcttaacgtagaaccgctctatgttaaggaagaccctcagttttcccgggtatcttaacgtagacgaactctatgttaagaaagaccttcgattttgccggatatcttaacaaatttcgctatttctgccgctttcattggaaaaaagtgcaatcttttcctataaaatgccgaaatggggtaccattgtgaaaaaattttgatagaatgataaatagagagataaaaatataaatggaggttacacgagtgtgagaaagaaaacaatcttttctgttgccgctacaaccattctggccacttcgtttacatcgcaggcatttgcccagacatataaagtccaaaaaggggattccctctggaaaattgcaaagaagtataatacgtccgttgatgcattgaaatcaaccaaccatttggcatctgacacgatttacccgaaccaggtacttaacgtttcagcgtccaaggcaaaagcttcggcccgttctgtttcggccccatcctcttctgccaaaacgtacacggtcaagccgggggatacattgagcacgattgccttaaaccacggcatatcggtttcaaacttaatgagctggaacaagctctcttcatcgctgatccatcccggtgacgtattggctgtttccaaaggggcagattccgcttcctcgtccagttcaagcagcagttcgcgttcaaccggcagttccaattccacgactacatacacagtaaaaagcggagacacattgtccggcattagcaaacagtttgggacaaccgtcagcaagctcaaatctttgaacaatttgagttccgatttgattttttccggccagaagctgaaagtaaccggtagcagctcatccggttcctccacatcgggaacggcaggcgctgccagttcaaacagttccggctccacggctacggctacatacacggtaaaaagcggagacacattgtccggcattagcaaacagtacggaatcaccgtcagtaagcttaaatctttgaacaatctgagttccgacttgatttatgccggccagaagctgaaagtaaccggcagtccgtccgattcttccaaatcggtcacaacagtcgatacaacttcaggcagtacccattctgtatcttctttaatcagcattgcgaacagcttaatcggcacgccgtatgtttggggtggtacgagcccgtccggatttgactgcagcggttttatctattatgtatacaaaaaagccgggtacagcatttcccgcatgtccgcagcaggcctttataaccgttcttactatgtgaacagcccaaaggcaggagatctcgtcttctttgaaggcacgtatggaaccaatccgagcgcgatcacgcatgttggtatctatctcggcggcggccggtttatcgccgcgaattccgatggcgtatctgtttcttctgtcggctacacgtactggaaatcccattttgacagctataaacgtttctattaatgttctataaattgaaccaaaaaaaccgcggatcttccgcggtttttttgcatctgaaccggcttgccccgatttgattcttcttacatataaaatttaaagcggctgccggcgtattgcgctttgacatattcaaacggtgtaccgtctgaaagcgaagtcacgcgttcaatggacagcaccggtgaacccggggccacttttaacagttttgccagccgtgcgctcgccgcaacggcttcgattgtctggtacccttttccgagccgcaatcccttttcccgttcaagaaactggtagaaagaacggtttaatttttcttcagtaagccctgccgcaatccttgccggggtgatgatcgattcgaatacaatcgggatctcatccccgtagcggagccgctcgatatgaagaacgttttccggctctttcagcgtgagtgcctccatttcctgcacggaggcttccctttcaaaaaacgccacgattttattcgaagctttcatcccgcgctcttccatcagccgcgtaaaactcatccgcccttccaaaggctgctccaccttatgttcgctgataaacgtgccgcttccccgttttctcattaaaatgccttcatccaccaaaccttgtaccgcctggcggactgtcattctgctcacttcaaaaagatcgcttaacacccgttcagacgggatggcttcgcctgttttccattccccctccctgattttcttccggatttcttcctgaatttgaaagtaaatcgggatcggggaggttttgtcaatcatggcgctttccggcatcctccagcaaagaagcggcatctgcatcagcaacgacaacgacatccggatgcatttgcagaacggatgccgggcaggcttcgtccaccggccctttgatcatgctgcggactgcttcagctttgcttttgccgaatgccagcagaacgatttttttcgcgtccataatcgaagcaatccccatcgaaagggcgcgatccggcacatcttcttctctttcgaaaaagcgccggtttgcttcccgcgtcgattcggtcagttcgacaatatgggttctggaatcgaaggaagtgcccggttcattaaagccgatgtgcccgtttttaccgatgccgagcacttgtaggtcgaccggatgcgtttttaaaattctttcataccttgcacattcttcttcgaggtcttccgccgttccatcaggcagatacgattgtttaaaattcatatgcgaaaacagttctttttccatgtaataacggtagctgtgttcatcggtatctttgaggcccacatattcgtcaagattcacagtggtaacgtttgaaacgtccagtccggcatgccgcatgtaagcatacagtttcagcggcgtgccacctgttgcaagcccgagcgtgcggatttgcccttcccgaatccctttttcgatcagttcataggcgtattttgctgcttcatcgcttgttttaaaaatatgcacatccatttttatccccgctttccaagatgatatgtttttttacctgatctttaccggttgtaagacttttttactgcgcgactggttattcccgctctccaaggtgatacgttgttttcacttgcaattgttcatccagcagtacaaaatcggcatctttcccggccgcaagacatcctttttgttcgaggccaaactcgcgcgcctggttcacggaagtcatctgtaccgcttctgcaatcgaacagccggtaaatttcataatgttgcggaatgcatcgtccatctttaagatgctgccggcaagcgcaccattttcaagccgggcttccccatttttcaccagcactttctggccgccgagctccgactccccgtccggcagccctttcgcccgcatcgcatcagtaatgacggagattttttccggcccttttatttcatacgtgaacttcaccatatccggatgcacatggataccgtcaacaatcagttcaacttgtacataaggcgacagcaacgcatgccccgcaacgccaggctcgcggtggtgcaggccgcgcatgccattataaagatgggtcgcgtgtgttgccttgctttgtaaaagttcagcacggacggcatctgaatggcccatggaaggcacgatgccgcgttcaatcatcacattttcaaatgcccgtgcaccttcattttcaggggcataggtgacaagcttaatgagattgccagaagcttcaacccactttaaaaacagttccgtgtccggcgccttaatatattcaagcggctgggcccccgctctttttttcgaaacaaacggcccttcgagatgaatgccttcgatcgttgtgccccctttttcttttgccactttaacggcgcgcaaggcggcttcgatttttccgtaatcctgggtcatcgttgtcgcgaaaaaggaagtcaccccttcctgccgcaatttttggcttaatgtaacgagcgcctccggatcggcatccatcgcatcaatgccatagccgccatggatatggacatcaatcatgcccgggatagttgtcatccctttcccgtcgatcacttcttcccctgcttccggccggtaatctgccattttgccggtttcaatgattttatctgtaaaccggataaatccgtctgcaatatgttcattccctgtataaagattgctgtggatcagcactttttccgtcaacggaaaacacctcttttttaaaatttatatagttgtctataccaattatcattcatgatgtgtcagatgtcaatctttattatggggaaatgatttctttttatgcaggttctttcctgattgtctgtaaatctatttttccgcggcaagttgatatatactagaaaaagtgcagaacgaacaaatcatggaggactttttatgaaacaaaccaatgtcaaggcggtcacaatcgccctgtttgtggccacctttttaacagccattgaggggacgattgtcagcaccgcgatgccgcggattgtgagcgacctgaaagggatcggcgtgatgaactgggtatttgccatttatttgctcacttcagcagtaacggttccaattttcgggaagcttgcggatttgtacggtcgcaaaaaaattttcacggccggcaccgttgttttccttgccggttcgacattgtgcggtctcgccggttcgatggggcaactgattgtgttccgtgccattcagggaatcggggccggggcgatcatgccggttacgaataccatcgttgccgatatttatccgcatgaaaaacgggcgaaaatgctcgggtttatgggagcggcatggggcattgccggtgtcatcgggcctcttttcggcggtttctttgtcgaccagctcacctggcactggatctttttcatcaatctcccgtttggctcgatttccgttttgatggtcatcctgtttttacatgagcaggtggaaaaaacggaaaatgcgattgatgtatggggggctgccaccttttccgccgggatgcttgcattgctttacgccctgcaaaaaggcggggatacaaacgactggggaaacccggtgatcttgggattgttagcaggcagtgtcattctccttggtttattcattttgattgagtaccggcatccggatccattaatgccgctttcgttgttccacatccgggccatttcggtttcaaatctggtttgttttttgggcagtgccgttctgatggggattaacgtttatattccaatgtggattcaagggcttgaagggcatggcgcaacgctttccggccttatgctggcaccgagtcccgtcctgtggatgctcggctcttttgccggcggaagacttcagttgaaatacggggaccgtttggcgtttttaacgggaatggccttcatcttgggaagcactgcctggctcagcctgttttcattgggaacgcaggaatggagtttttacgttttctccgccatttccgggttcgggttcgggattgtgatgacgatctcgctcgtttcggtgcagtcggcggtggactggtctttgcgcggggcggcgacagcatcaaatacatttttccggaatctcgggcagtcggccggttccgctgtattcggtacgtatttcaatgcaaaagttgccgaggaacttgcgaagggcaatccgggcgggtttacgacgaattcgctgaacaggctgatcaatcccgaaagtgcaggccggttttcggaagcggcgcgcgaatggctgcggcatgtgcttttttcaggcattcattcgatcttcatcctgcttgctataatttcacttgtttgttttcttctctctttcgcggttccgaaagcggaaggcgaaaaggggctgtcctgatacgcggggctgcctctttttttgggatgcttctgatagcaattgggggctttttgccgtttacgcattgtcccttagcgagcttcaaaggaacaaaagccagccgaatcgaacggtaactttcttttgaaatccccaagcaccaaaaaagccgcccctgtttgcgggacagccctttgtttaccattggtacggtgtttcctggtatacataatagttcagccaattggaaaaaagtaagtagctgtgcgagcgccatgtatggagcggcctctcattggcatcgttattgggaaaataatttttcgggagggcggtgccaagtcctctttgctgatcgcgcacatattcatcagcaagggttgtggcatcatattccaaatggccggtgatcataatatttttcccgttttcgtccatcacaatgaacggcgaaccctcttccgatatggaaacgagctgcagttccggatggttttcaatggctccgcgtgcaacatccgtatagcgggaatggggcgcgttaaaaacctcatcaaatccgcggaccagcttgaccatcggcaaaaacaagcggtgtttgaaaatgccgaaacacttttccggcagttcgtacttctcaatgccgtaatggtagtacaaggcagcctgcgcgccccagcaaatatgtagtgtcgacgtgacattggttttggtccaatccatgatttgcttcagctcgtcccaataatccaccgcttcgaaatccattttttcaaccggggcaccggtaataatcatcccgtcaaaacggcggcttttcacctcgtcaaaaaccgtgtaaaaatgttctaaatggtagctgctgacgtttttggattggtaagtcgacgtccggagaaaagtgatgttgacctgcaacggcgtattgccaagaaggcgcagcagctgcaactccgtcttttctttttccggcattaaatttaagattaatatattcagcggacggatatcctgcgttctcgccctgtcctcatccatcacaaaaattttctcttgtctcagcagctctccggcaggtaaatctttcggtatattgattggcattttcaacgtctcccccatactcagttgtcatgtatttttcattatatcggttttctgccgtttgctgcaatattcttgatagacagacagtttacggatgggatatgatcagcgtcagatgaccttccagttcaaaatggccaaatccggacggcagcagaaaatgcatccctttttcaagcggataagtttttccgtcggctttcatggccccttccccgtcaagcacgctggccagttcgaacggtttgttttgggtaaacgatgcggttccttttacatcccatttatatacagagaaaaaggcttcctttgcaaacgttgtgatggtaacacccggtttttcttccgtacgggggcggactgcggcatcccggtgcggtatcgttgtaacatcaatggctttttgcaaatgcagttcacgtttgttgccggcagcatccgtccggtcgtagtcataaacgcggtacgttgtatcactgctttgctgcgtttcgagcacaagcgtcccttcacaaagcgcatgaatcgtcccgctcggcacatagaaaaagtcccccgggtgaatcggcactttgcgcagcaggctgtcccattttccttcttcaaccaggcggacgaattcttctttcgttttggcatgatgcccgtaaacgagctgtgcgtcttccttgcaatcaatgatgtaccagcattccgttttgccaagttctccgttttcgtgttcattggcgtatgcatcatccgggtgaacctgaaccgataaatctgcatttgcatcgagaattttcgtcaggagcgggaatccttttccagacattccgccgaacaagtcacgtctttcttcccacagttccatcaaggttttgccggcaaattcaccgttttttacagtcgacgggccgttcggatggccggaaatagcccagcactcccctgtatggtcagacgggatgcggtaaccaaaccggtccctcagcgcggttcctccccaaattctttctttaaaaaccggttcaagaaataaaggctcgctcattcaaatcttcctccttgaaaggcaatcctttgctcaaatatgaacaaagcattttcagtccttttcattatagcataccgctcctgcacccgcgccggttatcccgtgtttttgcaccggccatttgctttccgcacgcaaaatttttttgcccgtttggggacgtttttcatttcttgcctgccatttttttgctgtccggatgccgcttttttgtttgccaaattttagtgtttatacgggggcgttttctatttctttatctgccaatctgtttttttgcaccggccgtttgtctgcaaattttttcatccgcagtaacaggtcagctttcatacaattcgatcggaagaccgtcgggatcctggaaaaaggtgaattttttatctgtaagcgggtcaatgcggatctcttctacttgaatgcccatttcttcaagccgctttttatccgcttctacatcgtccgtttcaaatgcaagatgccgcaagcccgcagcttccggaaatgacggacgcgcgggcggattcggaaaggaaaacagctcgatctgatatacgccgccgaccgaaagatccagtttgtaggaatcccgctctttccgatatacttcccgcaccggctccaatccgaggcaatcgacataaaaatgctttgattttgcataatcggaacaaatgatggcaatatggtgaatgcgtttcaaccttggagctgccattactttccctccttccgataagtccagccttcttcttgatagacggtgccgtttttcatcagacggccgagcgcacgtttaaacgccgctttgctgatgccaaaccgctcctgaatctcttccggcatgcttttatcccaatacggcatttttccgccgcgggaatccatataggcaaggatattttccgcatctttatccaatgcttcataagcgcgccccaaaagcgagatattcagtgtcccgtcttcttttacatcaatgacgcggccttccactttctgcccgaggcgcggttcgtttttgcgctgtgattcatggatgaagccaataaagccctcatcggttatgattgaagaacccgcttttgtcagtcggaacacatgcccggtgacatctttgttccacatttcccgaccggcttgtttcgctaaatccctgaccatgttttcttcggctaattttgcgaataagcgcccatgtttgtcaagatcaagggtaatgtataaacgatcgcctttttccggccagagcgagcggatcgggggcaagtcatcaacagaaagaagcatgtctttgtgaattccgatcgaaacgaaaacgccaagtttttctttggtgccggcaacttccgcccagccgtatgtccccaatcggatgtccggaatcacatttgtcgcggccagcctcccctgatggtcctgatatagaaagaccgtttgcaccgcttccggatcaaagggttccacaatatcccggtgatgcaggagcacgtcttctgtcccgttagataaaaaataaccgaacggcgcttcccgcaccaccgtaagttcggcaacggttcctggtgttaaatccattgcagcagtttcctcctccgtaaatcgtttgcttcataataggtaattataacattgatcggcggaaaacatgattttattttgaacaaggagtggaaatactatgcctgacaaacgtgaggtgacgcatcgggacaatgaggcggaaacggttgtcaatgatgcgcatgggagcaaccaggttggcttgttcagtgaacataagccttataaaccgtttgctgtgacagcgcttgaaacggataaggatatgaaaagattcgcgaaatttacagatggcaaacaggagtgatccaagtgagtaaatcaaagcgcgaagaagaacgacagtggaaagtccggaaagaatcgcaaaacccgcacggcaaagtgaaatctctggaagaaatcgcggatgagatattcgccgaatggaaagaaaaaaagtgagataaaggggtgctttcatggcaccccttttgtatgctggagaccgcgcgcaatcgggttttacaaaaaatggcttaacgattcccgcagatagtaaaaaacccgttgaaaacaggggtttcaacaggcccgaaaaatggcaacaaaaaataactgtttttttaacttccgataactggcagcacgcgtacttcttttttcatatcggagtggcagagcgggcagtgcggcttttcttcaaaagtaaagttttcacgcataaaaccgttgcaatcatcgtttgtgcaggcccatacggtcgtttccacctcaggcaccggctccttctggttattaaaatatgccatcataaaagactcccttcttatgtttagtataacacactttaacacaaaaaaggggaccggccctgctgcgttaacgtatgcaggcaagtgtgcaaaccgtcccggcgcattcgtgcatgcttctattatatgcatgcggccccggctttatgcgggcctccgctttgcacgaggcaagtgctgcagcctggaaccgggctggagccgggatccacactgctcgatacatttgcaaaacctgccttaatcgctactctacttttcgcaaagccgcggccattctttcgcgccactgctatttttgaagcaggtacttgcaatgcttcaaggcattgcatcatctgccctaaaatttactccgctttccgtaaagttcgcggccattttcttttaacgcacatgccattccaaaaccaggatccacacagctttggaacatacgcaacagccggcctcaaaatcatttttacccgctttcccactcactcatccgcttttgcggcaaacaagttttgtggcaataaaaattttctttgcaacggttctgccttccaaacgttccagcagcgtatcgactgctgtctcgcccatcaattccgtatacactttcacagtagaaagcggcgggaaaacatatttggacagcgagatgtcattgacgccgataaggctcacgcggccgggcaccgggatgttgttttccgcaagcgccctaaggcacccgatcgcaatcgcatcattggcggcaaaaaaagcggtcggaagcgcgtccccgtgttcgcggatcgcctcgttcatcaactggtatccgtcttcagtcgaaaacgcaccgatatatacccatttttcattccagcggcctgctgcctgcatccagcgcctgaacgccgtttcgcgcggatcctcaatcgtggcggacgcatctttataattttccctgccgccgataaagccgatttgtgtatggcctttttccgtaaaataggcgagcactttttctgtcgctttttcaaaatcggccacaacagcatcaaagcggttgtcgtcaggcgagcagtcgacaaatacgatattcggggtaacagagagaagcttctccacttgtgcaagactgaatttcccgacagcaataatgccctggatttgctctttccccatctcttccaaatgggtcaaatcgtatttcgtcagccggatatttttcatgctgcagcgcgcttcaatgcccattctgatcgataaataatacaaatcattcagctcttcttgttccgtataccagtacactagcgcaattttgattttttccggtttccgggctgtttttttcttgtaggaaagcgcttcggccgcttcaaagattctttttttcgtatcgtcactaacggaaagtgacgggtcgttattcagcacgcgtgaaaccgttgaaatggaaacacccgccttctcagcaatatctttaattcttgccattgttacacctcaatctttttcagccaaaaatccattttgtatgggcgcggtatgtttcacccggctccagaatcacagacgggtattcagggtgatggatcgcatccggcacaccctgcgtctcgaggcagaccgccaaataatcacaaggcttgcggccgcggatttcatatgtgtcatttcccatcgtattgcaagtataaacgacgacgcaaggctggtcggtttccaccgtcagcacgcgcccgctctcttcgtcttttaagcggatcggtttttccgtttccggcaataaaaacgcgtggtcatagccgtttccgacaaggacgttttgcggatggcccgataccgtgccgtcttcgatttttcgcccgttccggaaatcgaacgcggtgccggtgacatcgaaggttttccctgtcggcaacgtttcccggccaagttccagcacacggccactcgggatttgtagttcatggccgcgcacatcgcgtttcatgtcgccgcttaaattgaagtatgcatgattggtcatgttgacgatcgtttttttatccgtatgtgcctgataagacagcttcagttcttgttcatttgttaaaagataggtcacggtggcattgagatttccgggatagccttcttcgccgtccgagcttgtatacgtaaatctcacaccaactgcgccgtcttgttcaatgggcgtgctgtcccagatggcggcgttgaaccctttaaagccgccatggagatggttgcggttttcattggcagaaagtttgtatgttttgccgtccaattcaaaagaagccccggcgatcctgccggcaacgcggccgatgatggcgccgaaatacggaacgccatggagatagccgtcaaggttgtcatacccgagcacgatgttttccgctttgccgtttttgtccggcacgatgatcttattgatgatgcaaccgtattcaagcaccgttacagatatgccgcggtcatttttcaattcataagcatggaccggacgcccttccaattccccaaacaatgcctttttgatttccattttgatcagcccttttccgttaaagattgcgggccataaaaaacggcccggtgtacccgtctaagctaaaagttacggaatgtgatctgcagccccctatatgcgtcaaaagcgtatgctaaaaatgttggaacgcgtttccggctcctgttccccgcggccgcgccaatcgcttccggaatccgcagccggcctgaaagccacgtaaaaaaaccggcctgctgtttggtgtgcgcggtacattccggaaggcgtttagcagcccgcaccctttcaccgtaaacatgcgcaaaaaaggttggaacggaccgcctacaacttacgcaaaaaattccggaatgcctgttttcctctttcgtcccgtttaaagacgccggcgtgctgcaaaacttgcaagaagactttgcccacttcgttgcggacgatgccttccacgttttccgctgccaccgtgccttcgtattttttctttaaaccgtttgcccagtcaagatggtaggcggcaatggcgttcggctgcccgagcaaatatttctccacttcggccagctcatttttcagccgtgccggcagaaccgcaagccccatcacttcaatcagcccgatattttcttttttaatatgatggacctcggcgtgcgggtggaaaatgccaagcggatgggtttcgcttgtccggttgttgcggagtacaagatcaagttcaaacctgtccccgcgttttcttgcgatcggcgtaatcgtgttatgcggcgtcccgtttgtttccgcgaggatatcggcggaagggtcgctgtactgtttccagatttgcaaaatatgatccgcagcctcggtaagacgtgccgcctctgcactccgcagccggatgaccgacatcggccatttgataacggcggctttcacatccggaaatgccttcatttcaaaacgccagtcgtcagccgcttttgccatcgcaaattcataacgcccgccctgataatggtcgtgcgacaaaatcgaaccgccgacaatcggcagatcggcatttgagcccaggaaataatgcgggaaccgcccgacaaattcaagcaatctttgaaaagccgctttgtcgattttcatatcgcggtgtgtttctgacagcacaatgcaatgttcgttgtaatacatatatggtgaatattgcaaataccacggctcgccgccgagggtaaggcggataagccggtggttcgaccgtgccgggtgccccgttctgccggcatatccttcattttccatgcaaagaaggcatttcgggtaatggccttttttggcgtttttttccctggcaattgactttgggtctttttccggttttgaaagattgatggtaatgtcaagatcgccgtattccgttgatgtcttgtatacaatgtttttcgcaatctgcttcgtttggatataattgctgtgtttgcttaacgcgtaaaaataatcggtcgcttcagccgggctttccgcatatttttcccggaaaatacggtttaccgttgatgggcgcggtgtaaacacattcatgacgtggcttgcaaaaatgtctttctcatccagtacatcctgaatgatgcctttttcgcacgcgtaacggacaagcatgccgaggagatcaggaatatcctgatctgccccgcctgcttccggttcacggaattcatccagatgcaaaagcgacagcacctggtttctcgcatacacccgatcttcttccccgattaaccgggtgcggacagccttgtttacaagctgctcgaccgtttcaaaaattgccactggtttcaccttctgtcgtcgtaaccgtttggatggctttcatgccagttccatgcatctttgataatctggcggatatccgttttttgcggattccagccgagcacacgtttagccttttcggatgaagcgatgagcgtgctcggatccccggcgcggcggtcgccgattttgacgttaaagcctttgccggtcacttcccggacggtatccacaatttctttgacagaaaatccgttgcttgatccgaggttgaacacatcgcttgcgccgccgttctgtaaatattgaagcgcaagaatatgggcatcaatcaaatcttccacatggatgtaatcgcggacgcatgtcccgtcttttgtatcatagtcttcgccgaaaatggtgatcgcctcacgttttccaagcaccgtttccaatacaaccgggatgagatgcgtttccggatggtggtcttcgccgatttcgccggttgatcttgcgccggctacgttaaaatagcgaagtgcaacgtatttgatgccgtacgctttttcacaccatttcatcattttttccatcgtcagttttgtctcgccgtaagtgttggtcggaacggtcggcattgtctctgtaatcggcacgcgttccggttccccgtatgttgcggcagtcgaagaaaacacaatatgcggtacatggaattctttcatcatttcaagcacaatttgcgtaccgtatacgttgttgtcgaaatatttcagcggctgttccatcgattcgccgacaagcgagttggctgcaaaatgaatgatcgcgtcaattttttctttcccgaaaacttcctgcataaaggcacggtcgcgaatatcgccttcataaaattttgcctttggatggattgcggcgcggtggccagtttgcagattatcaatcaccaccacgtcatatttttggtcgatcagttgatatacggcatgcgagccgatataaccggccccgcctaatactaaaatgctcatgcaagttcctccattgtcatttcttttgctccgtcaccgatgcttgcggtgtagaagtccgcccggtagccgatttctttttcatagacgtccccgacatttttgatgaacgcatcgactttgtcattttcaacaattgcgattgcgcacccgccgaatcccgcgcccgtcattctcgccccgagcacgccctcctgcttccaggcggtttcggccagcgtatcgagttctttgccggtcacttcataatcatcccgcagcgaacggtgggaggcattgatcagttctccgaaagcgggcaggtcgccacgttttaatgcgtcaagtgcttttagcgtgcgcacattttcgtaaaccgcatgttttgcccgtttcctcacaatctcattgtctatgatttccttgtttttttcaaatgcttcttctgtcaaatcgccgagcgtttcgatatcgagtttcttttgcagctgtttcagtgccgattcacattccgcacgtcgttcattatatttagagtccgcaagttcacggcgtttattcgtgttcataatcaaaattttatggtgatccagcttgatcggggcatattcgtacgcaagcgtggcacagtcgagcaaaatacccgcgtcttttttgcccatcccgaccgcgaactggtccatgatcccgctgtttacgccgataaattggttttccgttttttgcccgagcttgacaagatcgagccgttccactttcaggttgaacaatttttcaagcatcacgccggttaatagttcaatggaggcggaagaagacaggccggccccattcggaatattgccgtacacgaggcagtcaaaaccctgttctatttcatgccccgcttccttcaaatacttcagcatgcctttcgggtaattggcccagtcatgtgctttgttgtatgccagatcgtcaagcgtaaattcgatgacgcctttttctttaaaattcaaagatacaaagcgaatgttgcggtcatcgcgttttttggccaaagcatatgtccccatggtaatcgcgcacggaaacacatggccgccgttatagtcggtatgctccccgatcagattaatccggcccggcgcaaaaaacgcgcgctccgccgccgtcccgaaatactccttaaaagcctgagacaaatttgggttgctcatggtcgttcccccctaagtgtaatagaatagaataaaaagattgcaaacgttttcttcaattccatcttacacgcagaagtaaaaaaaggcaacatttttactaaaatttttactggtaatattccatttctaaatagggcttgctgaacgaatccgattctgagtttgtaccaaatttgtctgcaagctctgtcgcaaaatatatgtgagaatgcgtgattttgtcttctaaatacgttgaatcggctttcgagtgcaagcttttccctggatttgttgtaaaatccttgcatttaaattgttgccaaagctgtcagcactcttgccaaatctaggaattttgcttattcagcaagccttaaataatacagcctcagtacaatcatttaccattccaatgcgatccactgctgtaataactgatttaagattttttctcttctttttttaaatcatcttttaaatactccatatcttttatgtacctttggattgtttcttctattgcgtcttttactactcggggatatcccttttcatcttctagtttttgttccttctttagctcatctatatctttagtaagcaaagatatagccttcttcttctcatctttactcatgaattcatagatttttctcataaaaaatacctcgacaataaattatttctaaatttttatttttttattataatacgttttgataaggaggaggcttctgttatacgcagcttgcagatgtcgagcaagaaacaaacggcctgctgtcttacacccgcaagccgaaaaccgccccggaaaatatcaggaaaatccttgaaaaatggcaggatgaaatcgtacgggcttatccggcacatcatcgaacgtaagcaaaccatggagcggcaacagtgcatttatcagcagttgccgcttttttagcagtagcgacaaagcggaccgaaaaaagcggcggcgctttgctgctttgcgccccccctttttcccggctgcttagaccatcgggtgctttttgattttacacgcgtgcgccgagctgcataaggacggtatcatccatcggcggattgtgtaatcccgcatgcacatcacggtaatagcgctgcagcgggcttttttcggacaggcttctggcacctacgattcgcatcgctaaatcaactgcttctatcgcatgattcgtaaccgccattttcgctgccccaagttccgggcccatctcttttctttgttctgctccggcttcatcccacattttcgcaaccgaatacagaaaatgccgcgcctgcatcaatttcagctcgatttcaccgaatttctggcggatagccggcagttccgcaatcggatggttcaggctgttcggcgtatacgatttagcaaagcgagccgcttcccgttttgctgcctcggcaatgcctaaataacaggcagggatatggagcagataaccggccggctccttctttttcgtctggatctccgccaggttcgcaagcgggactttgacgttttccagcacaacatcatggctgccggttgcccttaaagcaatgctgtcccatgtttcgacgatggagaggccagccgtatcccgcggaacgacaaaactgccaaccgcttctttttccggaatcgttgcggtaatgataaaaaagtcgagcaccggagacatggtggcaaaagtttttctcccgtttaacacccattcgccgttcttttccgttgccgttgtttccggcatgccaccgcgcgtcgggctgcccgtttgcgcttcggttgcgcaagtgttgatgagggcggcctcccctgctgccgcacggcaaatgcgttcaaacaattgcccgttccatgttcttgtttcggacaaatgcattaaaatccccatatgccatccgatggaaagggcagtcgacccgtccgcaaccgcgatggcctcttgcaggcggacaagctcatacagcgaaatgccgcccccaccgtagttttgcggcacagtcagctttgtatagcctgtttcttttaaatcctgaatattttcaaaagcaaaccgtccttccaagtcattggcagccgccctttcggaaaacgagccggcaagcgtttgaattaggtccagtttttcctccaacgttgaggcttttaaaaaatccatatcctttcctccccgtaaaaactctttccttttattttaccggaaacatgccggaaaaacatgacaacactttttttaaatttcctcttgcaatccagattttattataatataatttacattgtcctgattgattccatgctggtgtagcacagttggtagtgcacttcactcgtaatgaaggggtcggaggttcgagtcctctcaccagcatctttcttttttccatatggagaagtacccaagcggctgaaggggacgcactcgaaatgcgttagggcgggtgaccgtcgcgtgggttcaaatcccaccttctccgccatacataatgcatataaaaattccggagaacttcggaatttttttgcgtttatgaaccacatggcaattcatgctcccaatccccgtaaaccggattcgggaatacgataaatttgcggccaaatgcatggcggaaacggtctgcttccagactgcgcgccttgtttccttttccgtcaaatgtcttaaaaaagtcccctaaattatcaccgaataaggcaatgatgtcgtggtccttctcaacaacttgccggcgcgtttctttgctgcttgttcctttttgcaacagcacatgggaacggacggcctgcgggatcccttcttttttcaagttgcgaagggtggcatccatatatttttcgtcacggtttgaaatgtaataaatatcgattccttttttgtcggcatattttaaaaaggaaagcgcccccgggagcggttttgcttttgcttttttcacccatgctccccagccgctgccaaacgaaatgcccttttctgccatataagataagtacggcccgttatccagcaccgtttcatcgaggtccagcacgatggcccgcttcttttttacctttgttttcaggctctcctccatacgctgttttccgatattgtatccttgataataaagcgctcttgcttccccagatgtccggtaccaggcaacccccattttggtctgttccgctttttgctttgacgtgcagcccgcaaccgggacccgcttcatgacggcagcttcccggttttgtttgccgccttcagcagagcatcctgcattgccgagcaccagtgcaaagaccattagcaatcctgcaaaatagttcatgcttgccccttctttctaaaatgcttttacgtttagtatagaggaaccccggaaattgatacatgctaaaatggcatctttcacgagggtggccaacgttcacttttttccggattttacccgcaccttcacttaagcctatgtctcatccgtgccagcaaaaagcagcccttttccaatttggataagcggctgcttttttcattatcgcttggatgattctttctccagcaccaagttttctttctttttgtccgaaaatattttttccaaggcttccggcaaggcgatcatgcctggcaggaaaaatggcaataggataaagcaaagcacggcaaggccggtaatgacagcgatcgccaattcagccagcaggagcattcctgaaggcatcagggtggcaaaggtgccgcctaaaataatgacagcagaaatgatgacaccacctgtatgtcttgaggcgagtataatcgcttccctcgggtcaagcagcggatattccttatagcgcatcatcaggaagatgctgtaatctacaccaagcgagacgataataataaaggaaaagaacggcacaaacgaagaaatgccttcatagcccagcatgccaagaaaaatagagttgatgacaaacatggctgtataataggcaccgacaagggatgccgtaatgaaaaccggcggccagaaagaccgtataaccaacagaagcacaagcagcacgctgatggtcacgatcacggtcgatttagcaaggtcccttgacagaatatggttcatgtcgttggtcgtcgcacttgtgccggctgtcccgctgtccgcttttgaaagcaccgttcctttcagcccggcggcagccgtattattgatcttatcaatggtatccaacgcttgatttgaataaggatcgtcgctcaatacgacagtcagtttcgtcacttttctgtcatccgacatatacgtgtccattgcttttttaaaatctttgttggtgagcgcttctttcggaatatggaatgttttttccgttttcagctgcgccagatagtcatttgttttgccaaggccgtctgaaatttgctttaatccgcggttaacatccgacagcttatcgccgaactgtttaaaaccgctaaggccggaagcgagttgctgctggcccaatttcatttggcccagcccctttgccacatcgttcatattggttacaattttgccgatgccatcagacgcctggccaagcccggtttcggtcttcttgagcccgtctgccatttgcgaaagcccgcctgccatcttggacagattggcgtttgctgtcttgaacccggttgtcgtctcgttgtaattgctgttcagcgtgttgattccttccggcgtgatttgcttgagggacgatgagagccggtccgtcatttgcgaaagcgccaaatagttccggtcgcgctgcacacttggcgtactttgcccgagcgccgccacgagcgtctgcatttgtgcaatcgtactttttacaccaaggagtgcttgtgcagcctgctgataatttttgcccatttcagcatagccggcctgcattttcccgtaatttgcagacaatgtgctgatcccgctgctcatttgggaaagatttttttcaatggtagcgataccgtttgccagtgtttccggctggccgggcccattgccaatgccgttttggattttttcaagtccggtcgcgagagcgcccattccgttttcaagtttggcggttccatctaccatgtcgttcactttggaaaaatcggcggatccgagtttctcccgcgctgtctttaatccggcattgatttggtctacaccgttctgcgtttgcgacaagccgtccgttaccgtaatcatctgcttatctaggaaaaagcgacagccgccaacgagacgagcggggtcacaacggagcggaacacaatcaccagcacaacgagaataaaaatgacggttaatgctgcgctcccctcccctgcatatttatcattgaattccctaatatacatcgtatccgatatatcgtacacgatgtatattaggcgaaaacaaaatcattgtcaataaaatatcggctatttaaaatgggctgaaaattccgtcaagtgtgtaaatccattcattgtgtgatcactgttatttcgggcgattatttttgcaggcaacagaatagccattttcctttcatcttactatagtaaaaaccgggacgggcaccagcctgtgtttccatgattggaactgcgacggatttccccgccgattcgcgaccggtgagaccttatttaaaactatcccagtcttttggtacggttgtccttattttttcccggtaagctgtggcgaagagaccggtgcactttattaagaaatttttccagtgacaccgtgtcatcttttcattgacatcctaacacggtgtcatatataatcttcatattgtttcttttatgacacggtgtcattttcaggacagatgcccgtgccgcaatttttcaagataggagaatatgctgccatgccgaagccaacttttttccggttgccgaaagaaaaacaggatactttgattcaagctgcaaaaaaggaattttcaagagcgccgctgcacgaatcctctgtcgcaaacattgtaaaggaggcttgcattccaagaggcagcttttaccaatactttgaagacaaggaggatttgttttattatttgctgcgttttctctcacgaaaaagcaaagaacagtttatttccactctccaaaaaaagggcggggatttatttgcggcttttaccgaggtctttcaatttgccattcaagacatccgaaaccaggaaaatgccaattttttcaaaaatgctttttccaatatgaattataaaaccgaaaatactttggcagaaaatttttttgaagaggatctgaaaaagcaggatttggctttgctccagtccgtcaacacaaaaaaattgaacatcaataatgaacgggaactgcaggatatgatcacgattttggaggccgtcacctttcataatcttgtgcaagcattcgcaagggaattaacggccgaagaagcactcgatcattatcttgcccaaatggaactgcttaaaaaaggattgtacagggaaccttctccggcattttcaggcaaggaataaaaacaacttacaaaaaaggggaaaaagataatatgaatccagcaatacaacataaaaagccgccctatctcatgatcggggttctttttatcggcgctttcgtttcatttctcaataactcgctgctcaatgtagcactgccttccatcatggcagatttacacatcaaagattattccaccattcagtggctcgcaacaggttatatgctagtcagcggcgtgctggttcctgcatctgcttttctgctgacccgctttacaaaccggcagttgtttattacggccatgttgatcttcacgttagggactgcgctggcagcatttgccccgaacttcgggctgttgctgacaggaaggatgatccaggctgcaggatcttctgtcatgggaccattgctcatgaatattatgctggttagttttccgattgaaaaacgtggaacagccatgggagtctttggccttgtcatgattacagccccggcaatcggcccgacgttatccggctacattgtcgaatactttgactggcgctttttgtttgaaatgattttgccactagccgttatcagtctcgttttggggatctggaaagcggaaaacgtcatggagcaaaataaaaaagcaacgcttgattatctctcggtcgtcttgtcttccatcgggtttggtggtttgctttacggattcagttctgcaagttcggacggctggacagatccggtggttttaacggcactgattgccggcagtgtggctttaatcgccttcgttattcggcagtttatgatggatgaaccattattggatttgcgcgtgtataaatatccgatgtttgcccttgcctctgtcattgccattgtaaatgcggcagccatgttttccggcatgattttaacacctgcctatgtgcaaaacgtacggggcatctctccgcttgactccggcttaatgatgctgccgggcgcaattgtcatggggattatgtcgccgatcaccggaaagctgtttgatcagttcggtccccgcgtgctggctgtcacggggctttccatcacagctgtttccacctatatgctggcgaatttacaaattgactcgagctacacgtatattattcttgtttacacgctccggatgttcgggatgtcgatggtgatgatgccgattatgacgaacggcttgaatcaattgccttcccggctgaacccgcacggaacggcggttaataatacagcacagcaagtttccgggtcaatcggaacagccgtttttgtcacgatcatgaatgctgtcacaaaatcgaaagcggaagacctgatgtccgggatcaatccgcttcattttacagcagctgataaagccgctttaggacaaaaagcgttgctggccggcatccaatattccttctacgtcgcgctcgcgattaatattgtcgtattgatcatgtccctttttgtgaaacgggcagatacatttaaaccaggcgccaaaaaggaaaacagaaagaaaaccatgcaaacaaaaccggctgcagattaacagctggaaaatgggcaccgcctttttaaaagaggcggtgctttttgctgtgcttaagattttatacttgaatcttcactatccagtggcagcacatttgtttttttaggatgcaaaaggaaatacgagccgaccacgagaacggcaataagcaaagtcagcagtacttgcggacgcaatgagtcgataaagatcatcgcgactaaaaccgcaacaatgcccaaaatggtgacataagttaaatacggatacagccacattttcaccttcaaggcatccgggttcgttttttccaccgtccgacgcatgcgcaaatgggaaaaggcaatgacaaggtaaaccaataaagcgatcccgcctgaactgtttactaaaaacaagaatactttatcgggggaaatataattaaaaataaccccgacataagcgaaaaccgtgccgcacaaaacggcataaaccggtaccccgtttttatttaacttcagaaaaattttcggggcatcgccggcttttgccatcccgtacagcatccgtgaatttgtatataaaccagaattcaaacaggaaagtacggcggtcagcacaatgaaattcataatctgagccgctgccggaatgccaacatgttcaagaacggcgacgaacgggctctttaaaatattcgccgagttccacggaagcaaggtggctacaatcgcaatcgaaccgacataaaagatcagaattcgccaaatgacactgttagtagctgttctgactgccctttccggttcggaggattcccccgccgccactgccacaatttcggtccccataaaagaaaagatgacaaccgtaatgcccaataagacgctaccaaagccattcggcataaaaccgccattccctgttaagttggaaagtcctggggattggacgcccggaacgatgccgaaaataacggagaggccgagcagcaggaataaaacaatggtggccactttaatgattgaaaaccaatattcgaattcaccgtacgatttaacggaatatacatttgtgagcgttaataaaacggttaatattaaacttaaaagccacgatggcatttccgggaaccagtattgaatattcgctgcccccgcagttgcttcaatcgcaatgacaatgacccaaaagaaccagtacagccagccaatcgtgtatcctgcccaagggccaatggcttcacgcgcataggtggaaaacgaaccgcttgtcgggttcaccgatgccatttcccccagcattctcataacaaaaatgacaagtaaacctgccaaagcatacgaaatgactgcacccgggccggccgaatggatgacggcgccgcttcccatgaacaagccggcgccaatgactcctccgatcgaaatcatcgtaatatggcgaattttcaagtccttcttcagttgctgattctccaaaccctctctctcctttgaagcgcattttctaacaagaaacgtttttacaattgggagatgctttcttttaaaacttgcacgatcgtgcgaaagtcatcatcggttatgcttaacggcggggaaagctgcaatacattgttaaatccagcaacagtatcaccgttcttgccaattaacaggcctttttctttgcaggtgcttatcactttattcagtttttcgactgcagccggttcctttgtttgtttattttccaccagctcaatgccaatcagcaatccttttccgcggacatcccctacatttggatgatccttcaggcttattagcgcttctagcagccgttcacccagtatgcgggaacgttcaaacaacgcttcattttccattaattccaaattctttaaagccagtgcacaggctgcaggatttcctccgaatgtgttgacgtggcggaaacggtcataatcttcactgcccgcatacgcctcgtaaatttcccttttgacagcagtcgctgatagcgggagataaccgctcgtaatcccttttgccattgtaatgatgtccggcttcacgccgtagtgcataaaaccaaatgcctttccggtccgtccgaatccgcagatcacttcatcacaaatcagaagggcaccgtgcttttcgcaaatctctttcaccttcgccatataaccatcaggcggcagtaagatccctccgccagtaatgatcggttccataatgacgccggcaatcgtttcacttagctcccacgtcattacacggtcgatttccttggcactttcaagcgtttccacgtcttccggatgccggtacgtgtcaggaggtgcaacatgaagaaatccctgtccaagcggttcatacttatactttctttgtgcctggcctgttgccgcaagcgcccccatcgtattgccgtgatacgcgcgataacgggaaataaacttgtaccggtccagatcccctctttgccggtggtattggcgggcaattttaaaagccgtctcattggcttccgaaccgctgttagagaagaaaatgacgtaatccccgccaagccattcgtttaatttttcggccagctgaatggcaggcacatggctttgggataacggatagtatggcatctcaagaagctgcttgtatgccgcttccgccaattctttccggccgtaaccggtattcacacaccataacccggccatcccgtccaaatagcggttgccctcaatgtccgttacccaagcaccttccgcttttgtgataatcaaattgggctgcccgggacttgcggctcccctcatggcatgccataaatatttttcgtctgtttcctgtagcgtttttgtttgcaaatgcattcatcctcccatccccttgattaagttacacgctgtcgtcttttttgcgcgtaaaaacagtgtgcatccttccccccatttcccggccaaaagcagctcaatggcaatattccgactgccttgctgctggcgggtatgggcttccgttcttttgacggtgccatgttcgccctggcatggcattcatcctgaaaaatgtactggatgactttcattcttctctgcgaaacgggcgcctccccactgccacccatatcgatttttcaccatctgccatgccatacccctgttcgaagtcatttttgtaagcggattcagtgaaggttttgacaaatgattcacctattcacattacattccgacagagaaccatcctccaaccataaaactgaagaaaccagtagccagaattttggatataaaaggggtccccatgcccggaaaatcacaacggttggctaaacaacactatgcgcatattatagaatgaattttttatcttttcaataccttttttctgaccacaggcagaaaaggttttattgcagccgtgtctgatcaagattgtaacctatgatcgggaagataaccacatagaaaagagaaaacagttaacagttcggaaaaaaattaattttccttggattttatggaagcgatttcgaaaggatgctataataaaattgctcaaagcttggtctgggcataccatgaatgatgaatggaggtgtacggcttgaaaagcttctttttatctaaaacgtttattattacttatttgattgtcttagttgcatttgcatcacaaataatgtctccagctataaatgttaattatattgccttgatctttggatcttttgtgatcgctgcagtaatcacatttataataaaagcattcatcaaattaatagatgtaatcacgaaaaaaacatcttaaaaaagctcctatataaatgaacaaaatatcgcagctccgttgcctgctgaataaagtaggcctcatgcaaattgctgctcatgcttgatgaaaaacttaagtttattttatataataggggctttttcttaacaccgttgttttcattttaaacattcgcatgagtaggcaccatcagcaactcggctttctacattaaaagaaagctcttttcgcggctacaagaagagctttctttcatttttaagccaattgctttttctttttaagtgatttgaagagtccacagcattttagcagtacatgcgttcatacggatccattcatccgctttagtcttttaaaatggcagccatggaggtccggaccatttacacttatctcatctctaaaattccccaaaccaattggttatttatttccagcaggatttgcatttttctttttgaacgcggttagaataagcataatggcaagaacagcaaaaattcctgtcgttatcagtacagcgcctcctaatcctcctaaacctcctaagaaaaggccgacaacaccatagtctgtatcagagaatgtagaattttcaaagccaagattgcctaataccggcatcaacgcaatcggcatgaaactaataacgattccatggatgaatgaaccgagtatcgcacctctgcgcccgcctgttgcattgccaaatacccctgctgttgcaccacagaaaaagtggggaacgacgcctggtaaaacgattatcgtgtggaaggcaatcatcaggaacatgctgacgattccgccgataaagcttgagaaaaagccgaccaaaacagcatttggggcatatggaaaaacaattggacagtcaagtgccggtttagagtttggaactaatttttcagaaatccctttaaacgccggaatgatttcgcctaagatcaaacggacacccgaaaggatgacaaacacacctgcagcaaaagtacctgccatttggatggcataaataataaagtttgttccatcgcttagttttgcttcaatatatcctttgccagtaaaaatagctagaattatataaataactcccatcgtaagcgttatggcaaccgttgaatcacgcaagaaggaaaggccttttgggactttaagatcttctgttgaatggttttgatttccgaaaaatttaccaataacagctgaaatcatgtatccaaaattaccggtatgtccaagtgcaacttcatctgtaccagtaacatttttcatgaatggctgcacgatagccggtgacaaggcatttgccattccgagaatcaatccgcctaaaaggattaagggtacggatgtaaaaccggataccgtcataatgaccgcaatcatacaggacatatataaagtcgcatgccctgttaaatagatatatttaaatctcgtaaatcgtgcaatgaaaatattgacaatcatgccaaccagcataatcaatgctgtcggtgtaccatattttgtgagggcaagggctacaatcgcctcattatttgggacaacaccctgaacggaaaaagcatgtttaaacatttccccaaatggtgttaaagaattctgtacaatacccgcaccccctgttaaaaccaggaatcccacaaacgtctttataccgcccagcaatatgttactgatcgatttcttttgaaggattaaaccgataacggcaattaaagcaacaagaagtgccggcgtactggcgataccaattaatacatttaaaaaatctttcatgatctcgtcacctcaatttgtctgaatgaaaaaatactgctttgttcattcatctttggttagatctggataaaaaaacgcatccatgcacgaattttttgcttatccatgaattattcaggcaaacggccggattcttgcaaaaattgaaccactttttctttcaattcatttttatcaataatactttttaatactgttactttctcggctccaagtttttcagtagcctcagctaaatcctggccgacaaagaaatggtctgcagaatccggggtggcacttcccatatcgaagtgagtcacttcaatatcatcctgattaatccctaattgatctaaaatcgacttgatgttcatttcaatcatgaaactggaacctaaacctgatccgcatacagctgcaattttcattgaatattctcctcctctgtaataatggataaaatttcttctttcgttttcgcatgtaaaagttgctctaatttttcttccttccccagcaatgttgcaagctcggataatgcttttaagtgggccgtattatcgatggctgccaaagtaataaaaatcctaaccggatgttctttatctactaaatcaaccggtttatccagcttcaacagtgacattcctaagtgcttgacaccattttcgggacgtgcatgcgccaaggcaatttctctgccaatattgataaacggcccatgctgattgacaacatttatcatggcatcaatatattcctggttaattttgccctccattaagagcgggcttgcactcttttgaatggctttcatccaatcgaggccatcattttttacaacttgaattgtatgatcagttaatagctcactcaacattggctgatagatccctcctgttccactcttgaagtttggtttattaaacagctggattaatccttgtgttaagccattaaagtcatgaatcttcgcataatcactaacaacatccaaaatagatgagacaagttcatttcgataaatatcaaattggacaagatttttggtaagtatttttaaatcctgatgatccgggatggaatgaactgtaatgacttttttatttttttccggaatgtttaccgtggaaatcaccaggttttcctgtatttccgattgttttaaatactctcgctctgtgattggaccttcaaaacttacaaacggaaacaacgattgaagtttttgtttcaagacgacggaagttccaacaccgctgctgcagacaagcaaaactttttgaactgcttttgtaggccagtttttcctttgtttatcaatttctgcaccaaaataaatcgagattaacgagatttcatcttcactaatagaatgtttacaaaaggcttcaaaaggctgaatggagaaccttgtaaatgaaaatacattcccgtaattttttttaatttcctttaacagcctgttttgatacttcacgccatagcgcacccgatagtaacaagcaagaagatgcacgtacagattctttttcaattcataaatattatcgaaattgatgccggatatttgttgaaaacgtaaaatcactttttcaacgaccgtatccaatccggtaaatttttgcggtgcatatttggactccgaactgataaaattgatctggctgctcaaaagaagtgtttctatataaaagatttcgttttcatatacttcaggattaatatcaaataactttaacagctgcgaaaccagttcgtattcagggtacgttttcagaacatttaattcgtattcttttaatggtccgactgttctattctttttaattcgctgaataacaaacgggatataaaccgataaaatgtttatagcgtcgtccgaaaaatgttttcccgtcaatctttctacatcttctaaccatgcaccggttccacgtataaattgattttcagctttgcaatcgatgaagtgttgaaaatgttcactgcttatcatttttttgtacaaatttgagtgattgctaataaattcatgaaaccaccaacggatatcttcttcttttccgcttaaccagtagccgtgtttaggatcatttttaagggcaaggttggactttttaagcaggcttctggcccgatcaatatctgttatagcagtatttcttgagatattttcaagttcagacagcccttcaagggtaacttttttcgtactgattaaactaagcagaatatctatgttgcatctttcatcttttgaatatttaatcggtgttgattcttcgatggcatcccctgttttaagtattttttctttcgtttctttttttagatagtagccctcattcctgacattttgaatgggctccattttttttgcaagcaattctttatttagagcgttgaaaatataatagaccgttcttttggaaattttaaaggtgcttgataaatcttcaacagatgtgtatccttcttgatgtgctaagtagtttaaaatgagctttttcttggaagcgcccatatttttcactcccatttgttcctccttcctacattttcatcatataacaaatgttaaaacatgtaagcgcaatcagtgcagaaggttatgtgcaaaattgggctgcttaattgaaggatcaactaaaacagcacgactagaatggggagtttttctcagctgggcggaaattggaatatcttacagttaagttgaaaaaacaaatgaaattaataaaaagtgatggaaaatgtggcattggttatgtagatggcagttgatagaatagtttacgtccttgaagaacgaaaagtaacgaagcttgccggacgaatcagcttttggcctgttctgactcgtccagcaagctcgtccagattattgcttttaatactcgccttttatgacaaaaaatgacccccgtatggtgccggccagttttgacttttgtctggcaaatttaaacttcccttctaattcctttggtatttccatcccctcagaaagtttaaaaccaactgcccgcttcttcggatcatctacggaatacattacattgacaacgaggccgtcctcgtaaaagacgtaagcaaattggatattttccacttgaaaacgcgaagtttccaatggcttggctgcaaattcaatgccgcgttcttctttcaaaatcctattcacatattctagggtctctccgctttctgcagctggcaaaacagtaaatacgtgtttgtatttattcataaaatagcgcgcctcattcgcacgcaaaccggctagcgccttcgcaacaggtgaagactctagaccgacatcagacacatttttgaaatcaacgatataggacatgcgcaacgctccttttcctaaatggatttgatgtaaacacaacaatatataaaaaccattctatacttaaccgcttacaatatttgtcctcgctcaccagaaatgatcactgatatttttgggctctcacctagcatttctattataacaaaattggtagcactgaatggggaaattgctgaggcgagttttcggtgcaaaacatccatacaaatccggccgtgaccatttttgctaaaaaatcctggttgaatcatgtgcagaatccgctgcttttacatttcctacagcagcgattatttggataaagaatgtctcctcaaacccaagcttttgttttcaccaagaaaaaatctttcagctctccctcctattcatgttaagttaccttacataaaaaacaaggaaaacaccaacactggttctactttatctattttgaataataaatagataaagaattgtgcaaaatcgctagtgaaaaaccgtttatcctttgctatattaaaaatatagatgacattatatgtgatattaaatgacatcaaaagaaacatcccaaattcactaccgtaaatttattgaaaaggagctgaagcaatggctactcaattggaaagtgcttatccgcaaccgcagaagaaggcgagtatggatccctccctgatcccgaaaacagatgcagacagaacagttggccctttgaattatatttttatgtggattggggacggggtcaatattggaaatattacgcttggtgcaagtctgattgtggccgggatggcgacattaaacatttaccaaacttttgctgcggcattgatcgccatcagtattatttcaaccatcttttcattgaacgacagattaggctacaaaacaggcattccgtacgttgtccagctgagaatgtccttcggcgtaaagggttcgatattcacatcgctttgccgcggtatacctgccattgtttggtacggataccaaagctggattggcggcacggctttaaatgaaatggccaaaattgcaacgggcggagcttttgacaatgcggctgtttgctttatcgtgctccaattgtttcaaattgcgctctccctctatggctttcatgcgattaagtgggtggaggccctgacttcagtcgtgattttagctgcacttttctatgtgttcagcattcttctcacatcccatagcgccacgattgcaaacaaatgggtgcatgcaaaaggaacgtgggggctgccattctttgcttttatcatgacgtttatgggcaattatgccgccatctttttaagtgcagcggattattcaagagaattgaaagccgggatcagccatacaaaaagaaggttattgtattttattccgatctttatcgcatacgggtttgctttaacgatgggggccatgcttgcttctgctaccggaattacaaatcctgtaaaggctttttcagcagtggtcgataatccttatattacatttttcgtgtctgcgtttatcgtgatcgggaccgtttcggtgaatatggttgccaatattattccaccaacttacgtcattacattgcttacgaaattaaaatttaagtatgctgtcaccattacagggctgcttgcttttgcatcttttccatgggtgcttgtccgggattcttcagcaaaggggctcgacattttcattctggcttactcggcgtttttaggtccgattgtagccattctattgattgagtactacatcttccgaaaacaaaaggtaaatatcgccgacttgtacgcggaagacgggccttattccggctataaccctgcggctgtcatttcattagtaattggcgcggctgccgcatttgcaaaagtggaactggcatggatcatcggctttgttgcggctggtttagcctatatcattctgtcaaaatacgcatttccattttcaaaatttaaaaaggatacaatttttcaaaacacagtcgttctcgaatcaaatcacagggaggggattcacaatgaaatatgatacgctcataaaaaatggaaaagttgtttttagaaacagcgttaaaatcgctgatcttgccatccaaaatggaaaaattgctgtaattgcagataaaattgaggaaacggcaaaacaagtttatgacgcctcaggccaatatgtgatgccgggaatggtcgacatccatgtgcatatgtgcgaaccggggcggacggaatgggaaggatttgaaaccggaacaaaggcgcttgccgccgggggaacgacaacctatgtagatatgcctttaaatgcgctgcctgccacgacaacaaaagatgctttagaaaaaaagcttgccgctgccgccggcaaaaactatgtggactacgctttttacggcggattagtcccaggtaatctcgatcagttaaaagaactttccgattgcggtgttgttgcttataaatgttttatggccagctgcggaaccgatttgccgggagactttaaaaatgtagatgattacacgctttatgcggggatgaaaaaattagccgagctgggacatattttattgattcatgcagagaatgccgccattaccgatgggttagcagaggagatgattaaacaagggaaaacaagcccggctgattatgttgcaacacggccggtatttactgaagtggatgccatcaagcgggcgctgtattttgcgaaacaaaccgggtgcaaactgcattttgtccatgtcagcagtgcggaaggagtggaagaaattacgaaagcgcggaacgaaggacaggatgtcacgcttgagtcgtgcccacattattttacaatcacaacagcccaatttgcggaaatcggcccgcttgcaaaatgttccccgcctttacgcagcgaagcggagcaggaaaaactttgggaaggattgaaacaaggaaaaatcgatatgctgacatccgaccattccccttgcccgcctgtaatgaaggacagcgaaaccggaaatatttttgaggtatggggcggcataaccgggtgccagaataatgtcgatttgatgttcgatgaggctgtcaaaaagcgcaatattcccattacgcaatttacgcgcatgattgcaaccaaccctgccgaacgttttggcttaaaatcgaaaggggaaattgcgctcgcaaaagatgcggatctcctctttctcgatcccgaccggccatacacggtaagtgcggaagacctctattaccgccataagcacagcccgtatatcggcagaaaaattgattgccgggttacgaaaacttttgtaagaggacagctcgtatttgatctggatggcggtggtatcaagggtgagccggttggcaaatggatccggccagcgaaggtttcagactatgccggagtgccgtcataatgccaacagcatcaggctctgctttcaagagcctgattttgctggcataaattttggccggttatcaatagctggcatcctgtatgcaccatggcaaatgccttcaatcctccgtggtgcttcactcaaaacttacggttgcttacggtatgattgatcattctgtcccaccctttatttttttgtaaaacttttatcaaaacatagccaaaaatggcccctgcaaaagagcttaaaaagaaggcagggataaatccgaaaagcgttgacgcttggccgagtaagaaaacagcaatgggataacatgccaaggcaccgagaatgcctgtccccatgacctccccaacaaaggcaaaaatgagcttattcgtcttcgcgtacagataagctgccaaaaacgcgccgatcatgcttcccggaaaggcaaaaatactccccgtcccaagcaagttacgtaaaagcgaggatataaaagcttgcgcaaccgcataaccggggccgagcaaaacagccgagagtatgttggcaaaatgctgtaccggaaaaatttttgcaaaaccaaccgggatataaatcaaactgctggatgcagttgtgatagctgcaataactgcagttgctgttattttttgtgtttttctcattagaaccaaccttccctcctttttagttgcgaatgaaaatcagaccggccagtcttgttttttatcgttcatatcccaaaataaatactcatactttgaggctatttgaaaatggcgttctaagactgccagttccgtttctgattttccgcttgccagttggtccattaagtcaattaaccactgcgttccggagccgaacgtttctgaagaataggtttcgatccatttcttgtaaggattggcctccaatgtgtctcgatgatttacttttagcagtttcccaatttcccaataatcccaggcacacggcaacaagcaggcaacaagttcagccaagcttccattggcggccacttgcagcatgtaactcgtgtaagcaaggttgaccggcgttggttgggttgcttctaaatccgtccgagtaacgccaaactcggcagcgtattggcggtgcagttccatctcaaaatgcaacgattcatggagcaccgcagcaaatctcgtcatcatgccgaggttacccgctttcacaacacccatggcaaacagttttgcgtactcaactaaatatacgtaatcctgctttaaataatagataaatttatctctttctaaagttccgttccccagtcccacgacaaaaggatggttatggtttttctcccaaatcggctggacattttgatatagtctttctgtaaaagatcgtttcaacaatgattcctccttgtttaccggaaagccgaatgcggtttgcaggctggtttcaccctttgccccgagcaatggcaggaggagcatcctcaaaataaaaaaaccgccctccatcggaaagcgggtgtatcaattacaaatcatcaggtgtaatttcatcacctacttcccttcgctagtacgaactagatcaggttcaaagggtacttctcagccaacccggcgcccctagtagattattatgaatattcatttacattactcttaccatatcatagtatcgtattttgtgcaacaggagatttattgtccgtcttttaagtttttgtaaaatatggaaacagagccaaagaatgttgactcaaatgctgcccgtaccacgcttcagttcccgagatacggtatttttattacagccaaccatatcagtgattacttgcatggatttccttctgcacgaagggtggcaatcttcaccatagataaacccccgtattgattgcgtttttatcgcaaacggtttatcatgttttttttcatttatttagcttgttgcatttgattatccaactagccttttgtaattttatcaaaaaagcctatataatctactattgcattttcaaaataatcacctaaataaatatcgaaatgtccacagtcatactcttttatcgttgctttcttggagcgttttgcacactttatggttgcccaagcaggtgctaatgtatctttccgacaaaccgcataaaatatcggtattcctatatttttagtgtatctactaggcgaatatttaaagaattctaaaaccgatcttgcgggggctttattcacaaactttaaattttcaggcatcaacttaaaaacctttttgtagtcagaaacagccatcatcgctactttccccggcgcatccaccaatttaatcatgaccggatgatacccggtaatagaagataaaacgtcagctatggcaaaggggaatatttttagggcagatagtggtgagaccgttttcactgtagctaaggtgtttgtatatgggcactgtgccacggttgcaagaatatctattcgatgagctgatagggttataacgtgtcccccactaaacgaacttccaaacaggagtattttactatcatcaatgctatcattctttttgatgaaatcaatggcagagttccaatctgcaagttgttcttttacatttatccgttgtcttttatttccgtcacttgctccatggttacgataatcaaataaaaagcaggcatacccggcagcagcaaacctttcagcatatgcgtccaaccgcatttcacgcactccacccaagccatgagccattacaatgaccgggcaccttttatctacattgggtagatatagccacgcgctacaccttgttccatttgaataaaagtcaatatcttctcgtcgaaattgattgttcatttttctcccttctcccgcttcaagcgagcacaaacattgcacgaaatagaattgacatatacgtataaaaatggctccacagtgaactactctcacttcgatgggtcactcgaagtaggggtttctcgacttatcgttactttacgagctaatgaaagctgaccaagcgatcctttttgttccaagcgtttatgtttcatactaacaccaataagcatatgccttcttgtttgtatccccgaatattgctcaattcgtccagcgcagtttgtgaccaaaatacacgatactctttgtccacgcttaagaccccttgaaacatctccgaagatacttaagcccctgttctttgctgtaaatgcgtccgtttcgccgatcttcgcgactcttttgaacctgacgaacaacttcttcatcttttgccagatattcaacttccttttcgtttagtgcttgttctccccgcttgaaggttaaaaattcaataaaatcatacacttcaaggacatcttgttcaggaatttgatcaatcatccgctttaattcttcacggctcactctcaaaacgtttcaccgccttgtggtttattttctcattatattttttaaatgcaaacacactccacatggctcaggtgctgtgagatatcaggacgtcctatccgttaagcagaatctgggttagccatgagacatcttttaaaacgatactcaatcaatagcgtttgctgcgacattgaagggtattgattctggcccggccttaaaatagcagtaccggccactttccctaatttgccgcgtttcggcactgtccaggaaatggccgaaattggttaaaaatacttcaatttcaggacttatattttcggaaatctattttatcaatgtctttataattgttatgatctgctctataactattcatagaggaagcctcataaacacataaatattgttcaggatttagtaaataaaattgaacatcccccttttgatgcatttccggatcttctaattttacgcctgcaaaattggggaaagtgggtagttgttcttacccgttgccctgcaggcggtcaatcagctaaatagttgccttccatattgtccaccggtctttttcaacgatgttattttcctttgtcacctttttctggacataatcggtcagcaaacttagttcttgatcatccagttcatacaaaatgcttcttcctgttctttcacttatgtcttttaataattgcgctttattttcgtgcacctttcttgtttcccataatttaacttcttcaatttttttgaaccctgcttcttgcaaagcctcgatgaccgtttggctgctatgcctgcgttttatttcctcatcaattaattttggaaataactcaaataaataccctctgatgtttgtgttatctccttctaataagcaatcatcgggtgtgcgatcttgaataataaaaaccccgccatcctttaacagtctgtgtgcttctttaaaacaagcatgcaaatcccaaagatggtgtattaacgctctttcaatcaccaattgaaagctttgactttctaagcctgtatcataagcgtttccgagttgaaaggagatatttttatagtctttacaattttccttcgctccttcaagaatcggttccgaaaaatcgatgcctataacagtttgaacgcccatatctgccagggctttcgaataaatccctcctccgcacccgatatctaaagcgtttgatatatgctcgacagttagcagacttttcatcatgtcaatccaggaacgatccgcaacacgggttgtataagtcaatcgattttgcttactgtgaaaatcaattcccatttcttatccctcatctctattgaaaaatcatattactctaaaaactgaacttagttttttacatttagaccaagtcatccattttacatcctaattgcttttgcaaccggtaacaaaatagcaatgtttcgctcattctctccagctttattttattatacctcattggaaagaaaaattcggaaaattttattacaaatcataaatattcattatagtcccggtaataagccggctattggagatttttgattttgaataaaaaatcgccctgattttggaaaggtgattttcacaaaatcagggctttgtatcgttgctgtttacacatctaaaaccaaatgcgccacacattccacatgcaccgtatgcgggaacaggtccaccggctggacggcagtcagtttgtagccaaacggttcgagctgcttgatatccgttgcaaatgtgtccgggttgcaggagacatagacaatgcgcgcaggtttggcccggccgattttgcgcatcactttgccgccggcgccggaacgcggtgggtcgagaagcaacagttccgggttgccgaagctttccagcacttcatcaatccctttgcgtgcgtctttggcaaggaaatatgtgtttgaaatgccattgtcttttgcattccgttttgccgattcaatcgaggtttcaacgatttcaatgccggcaagttccccgacacggtccgcaaacggaagcgagaatgtgccgacaccgcagaacaggtcaatcattttttccgttttctccggccggcccatttcaagcgcaagatcgacgagtttctgtgcctgtaccgggttggtttggaaaaatgtatcgaaccatatccggtaacggtaaccgcccatttcatcgtaaataaaatcacgtccagagaggacatgtgttttttccgcctgtgtccggtctgcccaatcggtattttcgagccagagcaggctttttacttgcgggaatttgccggtgatccgctctgccaaatcgcgggccgcttcagctagttccccatccggcgcttcggttgcaaacagggcgagcatcatttcccctgttgcaaaagactggcgcaccattaagtggcgtaagaggccttcgtgcgcatctttgtcatagccttttaagccatgctcttttacccacgcggccacttccatcgcgccatctaccatttcttttccggcaatcaggcacgtttcaagcggaatcactttccggaaattcccttgctcatgcaggccgagcgatccatccggagcaaatgtaaattccattttattgcggtaatgccaaggattatccatgccgatcgtatcacggacaagcgccgggtcaaagccttgtgcggcaatggcttcttttacatggacggttttttgttttaactgcccttcgtatgcccagtgctgccagacacagccaccgcaacggtcaaagtgcgggcacatgggcaccaccctttccggatgggctttcagaatttcatccggaagtgcctttcttcttcttttttccggctggtctacggtgacgcgtactttttcccccggaagcgtacgcggaatggtcagttttaattttttcgcgttaccaagttcattttcacgccagacaaccgcctgcccggaaccttttgcatcaaagccgcggatttctgtcaccaatgattccccttgcaaaatggccaatccaatctctccttccattgaaaaacaaatatcttgaacacgtttaaagtgtaaaattttcgattcaaaaaaacgggcgtttcactgccttgtaatagtataatggaaaaaaagcggtttgcaaatgtgcatcgcaccgttgtaagccatcccgtaaataaagcttgctgggcgaatccgattttctacccaattgatcagcaaatgctgtcttaatatatagaagaaactatctgcaaaatgcaggattctgtcttctagtacgatgaaacagctcgagcgcaaacttttctctagatttttataaaccaaatctataaattttgcttattcagcaacccataagcaaaacaaagcccgtgaatctcgagttatccacgggccttgttttgctttctgatttccagtatttttggcagtttgatcgccagatgttcacgacattttcgctgtttttcatatatatagtctgttgccttttcaatggaaacaagcttgttgatttcatcttcctctatatcgaaatcaaattcatccgataactccacagccagctctgaaagatcgatccagtccgcaccgagatcatcgacaaaaagggtgtcgtcctttatttccgaagggtcatcatcgaaatcattcaacacaatgtcgcgcactctttcccggatattttcttttgaaatggtttcccgcatcatcatcagctccattgtgtaaatgttaacaaattgtttctcatctacttttaataatagtcattttacaacgccagcacaagaatgcaatacctgacgctaacttttttatgccaaatttttccgtggaaaggccgctgccgcattccttggaggcggatgcgcccgcacagctactctacaaatcaagtgacaaggacggatgcaaacactaaaatgatagtaaagtgtaaacggattctttcggtaaagcatatgcaccattcctttacccaaaagaattttctctaaccgtatatatcatattgaacaaaaccggggatgcctcggccattccaactgatgcgacaaaactgaaaatggcctctgcacttacgaaacgaggaggaagatggatgatttcttttgatgaacaaacgaaaactttccatttgcaaaataatgaagtgagttaccttttacaagtggatgcattcggctacgtggaacatctgtattggggaaagccggtgagggcctatcacggagggcgcgcctatccgcgcattggccgcagtttttccccgaacccgcccggtgcaaaagaccgcaaattttctcttgatacggtactgcaggaatttccgggttacggcaacggcgatttccgtgagccggcacatgttatccggcatgcggacgggtcaacggtcacggacttccgctaccgggcacatgacattttaaagggcaagccggcgcttcccgggcttcccgctacttttgccaatcaaaatgaagccgaaacgttgaaaatcatgttggaagacaagcttacaggccttcaattaacgcttttatataccatctttcgcgactttccggcgatttcccgcgcggctgtgctgacaaacggcggaaacaaatctgttcggattgaacgcttgatgagcttgaatgtcgatttcccggccggatgttttgagcttttgcatctccccggcgcccataaatgcgaacggcaaatagcaagagaaaccgtaacggacggcgtcaagcggatagacagcaagcgcggcgccagcagccatcaggaaaatccgtttttggcgcttgtccggcctgaaacaacggaattccaaggtgaagcatatgcagtgaacctcgtttacagcggcaattttgccggaatggtgcagcaggaccagttcggccaggtacgctttggaatcgggctgaatgatttcgggttcagctggacgctggagccgggtgacactttttattcccctgaagcggtgatggtatacagcagagacgggctaaacgggatgtcgcaaacgtttcacacgctctaccgccgccaccttttgcgcggcaagcataaagatgcggaacgcccggtattgatcaacaactgggaagcgacctatttccgatttcatgatgaaaagctgcttgaactcgccgacgaggcacaaaagctcggcattgagctgtttgtgctggatgacggctggttcggccaccgggacaatgaccgcagttctttaggggactggtatgaatacgcgggaaaaatccggatggggctcaaaaacctggcggaagaaattcataaacgtgggatgcaattcgggctctggtttgaaccggaaatggtttcgcgggacagcgaccttttccgtgaacatccggactgggcactgcaaattccgggccgcgggctttctgaagggcgctcccaatatgtgctcgattttagccgcagggatgtgcgcgaaaacattttccggcagatgacagaaattctggatcatgtccatgtcgattacatcaaatgggatatgaaccgccatatgacagaagtccattccgccctgctggagccggaaaaccagggagaaactgcccaccgctatatgcttgggctgtatgactttttagaaaagttgacatcgcgttaccctgatattttgtttgaaagctgttccggcggcggcgggcgttttgatccgggcatgctgtattatatgccacaaacgtggacgagcgataataccgatgcggccgaccgtttgaaaatccagtacggcacaagtctcgcctacccaccggttacgatgggcgcgcatgtctcggccgttccaaaccaccaaaccggccgggttacgccgttatcgacgcgcggtgacgtggcaatgggcggcaatttcggctatgagttggatttgacaaaatgcacggaagatgaaaaagcagtgatccgggaacaggttgcattttacaaagcacaccggcaattgttccagtttggccggttctaccgcctgataagcccgtttgaaggcaacagcgccgcctggcaatttgtctcaccggaccgcaaccataccattgcctattttttcaacgtactgtctgaagcagccggccagttgaaaatattaaaactggcaggccttgacccggacaaaaactaccggcatattgaaacaggcaaaatctacggcggcgacgaactgatgaacattgggctatatttgccattgtttaacaaacaggactttgcaagttacaaggcggagtttgaggtggtgtacgagtaaaaatacctcccctctgcccgggcagaagacactgaaaaacggtgagacactatgaatggcgcggtgtcttgccgttttctcttggactttttcagcggcttttctcctctcctctattcatttttgttatgaatgaatataacaattttttattttcatttttttctctatttcagtatagtatacataaaaccagtcttaaagaaagagggttcaactatggatgcatttgtagacgcattccgttctattcctaccacatgtatatcagatgctatggatggcttgaataacttgcaccctaggattaagccattgaaatcttcctattttctctgcggcaaagcttttactgttaaaatgccggtgggtgacaatttagccgtcctaaaagccatcagacatgcacaacctggcgatgttcttgtcgtggatgcaaagggggatgagtacagggccattgctggcgactttgtggtcgggatggcaaaaactttaggcataagcgggatcgttgtggacggcgtcattcgcgatatagatggcgttaaaaaactgaactatcctgttttttgcagaggcacaacggtagccgccagcggaaaaagcggtattggcgaaataaacgtccccatttcctgcgggggagtagccgtacatcccggggacattatcgtgggcgatgcggacggagttgttgtggtaccggcagaaagaggagaaaaaatattgcaaaaagcacaggaaaaaatgaaaaaagaccagcttagggaagaatccgtctccggaaacaaagaagagatcatcaagtatttagactcaatgatctcaaaatcataagctgcctgtctttagcactattgggattgttgaaccacaggagatgctccctgccggaaaaagcagccaccatgcaaatggatgtgtggctttgaaattaaattcactttattctataaaacagggaaacattgttattttgccaccggctgcaaacacatgaaaatggatgcgtagttttgaagttaagttcaccttcttcgataaaccgagcgaatcattgttttttcgctgtcggctgcaaacaccatgcagatggataagtcgctttaaagttaagttcaccttcttcgttaaaccgagcgaatcattgttgttttgctgtctgctacaaacacatgaaaatggatacgtagttttgaagttaagttcaccttcttcgttaaaccgagcgaatcattgttttttcgctgtcggctgcaaacacatgaaaatggatgcgtagttttgaagttaagttcaccttcttcgttaaaccgagcgaatcattgtttttttgctgtcggctgcaaacacatgaaaatggatgcgtagttttgaagttaagttcaccttcttcgataaaccgagcgaaacattgtttttttgctaccggctgcaaacaccatgaaaattgttgacttaaccccgatgcaaaagcttaagtctgttttacacgacatacggcggactggccaaatgcttcatagttgatattcatttgccagtttcctgaacgctgcaagcgaccgtttcactttctctgtcgggatgcagtaggaaatccggaagtagctcggaacgccaaacgtatcagaaggaacgagcagcaggtcatattcaagtgcttttttgcaaaatgccacagcatcctcttccaaggctttcggaaacatgtagaatgtaccacctggctttgtgatggaaaaacccatatcggtcaaggcatcgtacaaaatattcatgttggtttcatagactgaaagatccgccgtgatgtccagcacttcggcaacagcgagctggatgattgacggcgggcagttgtggccgatgccgcgtgagatctggccgcacatattgacaatcaattccgcatccgggcagtccgggttcacagccacgtacccgatccgctcgcctggcagcgacagcgacttgctgaaagagtagcatgtaatcgtgtacggatgatattttgcaacgtacggggcctctacacccttgaacacaatttccctgtacggttcatctgtaatgatataaatctcatgcccgaattcccgctctttttcttgcaaaatctgcgccaattcccggatcgtagcttcagaatagacagcgcctgaaggattgtttggcgtgttaattaaaacggctgccgttttgggcgaaatcatccggcggaacgcgtcaaaatgaatttgaaaattttccgtatcagcaggaacaacttttaacaccgcgcccgtttgattgacgtatggcacgtattccggaaaatacggcgcaaacgtgagcacttcatctcccggtacggttaccgcccttaaagcgtgtgcaatggcgccggctgcccccgtagccataaaaatatgttctttccggtacggcatgccaaaccgctgttttaaggaatctgcaattttttcacggactgaatcaatcccaaggctcgggctgtagccgtgcaccgccgggtttttcgcaagttccataagtttttcggtaaaagcttgcgggaccggcacgctcggattgccaaggctatagtcaaaaacattttcagacccgatttcctttgcacgtactgccccgtattcagcaatttcccggatgaccgatttctggccaagcatccttttgaattcttccgcaatcatgtttttcttcctcctgaacatcaatcctatgtatagatataactataacatattttgagcccgttatgatgaaattttctaaatttgctttcttgtttacagtataacagtgttatgttatattaaaaatagcaaaggagtggcgaaaatggatgaagacttaatttccaaaaaagatctgctcgaacaaaccggcatctcctatgggcaattataccggtggaaacggaaaaacctgattccggaagactggtttatccgcaaatcgacgtttaccgggcaggaaacctttttcccccgcgaacgcattttggagcggattgaaaaaatacaggcgatgaaagaaaacctttcgcttgatgcgcttgccgaaatgtttgcaccgggcggcgggaaacggatcagcaaggcagatatactgaaacggggtattgcctccgattttgtactaaatttttacatcgaacaaacgcaggcgcaagaacaggcttttccttttgaggaagtgctctccatttttttattggaaaaacttttgcacggcggggagatttcccttgaggaaggaaaaatgctggttgggctcttgcaggatgcagaaaaatcttttgcaacggaaggcacaaacgtatggctgatccgaaagttcggcgtttccacctgctttttgacaaaaaaggcagaagatattttgtttgaccgtgaagcaaaagtgattgtcagccttgatctgatggagttatcagcagaattaaaaggaaaatggctataggaggcgggcaaaagtgggaaatcttgtcataaacggagtcgcatcctcaaacggcgggacttttgacgacgtcatcgtgaatggaaaaggaacagtgaatagtgaaatcaagtgtaaaaatttggaatcaaacggaatagcggtttttaaaggaaacattgtttcacaaaatgccactgtcaatggaacggcaacctttcacggtagtctctccagtaaaagcatggaggtttcgggatcggccaagtttttggatgatgtcctggcagaaaatcttcacgtatccgggaatgcaaaatttggcggcaaagtgaaaggaacggaaatcctgcttgaagggaatgtgtctgttgccggagattgtgaagccgaggaaatcaacatccacggcaccgtcaaaatggaaggcgaactgaatgccgaaaagattgaaatgaacccgttgtggcgctgttttatccgtgaaatgggtgggcagcagatcacggtgaaaaaagtcaattctatttcaagctggttgaagccgtttacgcccacgggcctcacggttgacagtattgaaggggatgatattgtgcttgaaatgacgacagcgaaagtggtgcggggcgcccgtgtaaaaatcggtccaaaatgtgaaattgatcttgtggagtacaaagatacgtttgaaaaagacagctcagcggttgtgaaagaataccggaaaatataaagaaaggcgtgcagaacatggagagaaatcctttgattgtgaatggttcgggcgcttatggcggcggattgtacggaaatgttaaagtgaacggggaagcggaaattgtcgatgcgctcgattgtttgaacttgtcgatccgcggtacaagcaaggtaagcggcaatacaaccgccaaaacgatttcagtttttggcgaggggatatttgccggcagtgtagaggcagagaaattgaaagtttcaggcagctgccggattgaacgggatgcggaaatcaagaccagccttgtacgcggggagatggaaattggcggccggttcagcacggaaaaagcagagatcaaagggtcgcttgacgtcaaagaagatgtcgaagcagaggcttttatttcaaaaggaaagtttctagttggcggcctgttaaatgcggaagaaattgaaattgcgttaaagtatagcaacagccgcgcgggagaaatcggcgggaagaaaattgacgtccgcatgcaaggcgggcttcccggcatgtttgggaaaaaacggcatctgttgcaggctgatatcatcgaaggagatcaaatctatttggaatacactgaagccggcacggttcgcggggaaaatatcgaaatcggccccggctgcaagatcggtttagtggaatacacgggaacgctgaacatttcaaatgaggcagtggtcgaaaaacaacaagagtcaggagccaattcgtaaacagggggctaaatttgctccctttttttgtctcccacagcctgatgaagatattttggacgcggttgtttcgcggcgcacaggcatttggattgggggctgggcctaagaaagcgggggaaaatgacaatcttgacttagaacccctctaattgaacaaaagctcaacgctccctgaatgttttgtctaattagaaggtccaattagacaaaagctccccgaccggcgttcgttttgtccaattggctgacctgcgtgaagaagcgagaaaaaagatattccggcgttgtcaaactcgcttttgttcctcttgaaccctgcagcccaacctgtttcgccccctattccgatcgcggccactcccttttttccaaataacggaagccccaccttcttggcaatcctgtttttttcttgaacggcatgcttcccaaatgaaaaggcagtgcgatgaacgggtacttcatcgcactgcctttagtttggtattacaggggacccaaccatgccgcatcctgtatacattttcacattcggggggtagctccccaatgtatgaatggggttttcagccttttcccggctgccggagtgtgatgttatcaggacgcctgtcgtcggctccgtgacagatacaaatctttgttaagatttgctgcttttaaagcttgtgccttaaaagatccgtaactgatccggctttcctttgcctttccatattcttttgcctgaaagttcattgacatttcatttgactgttcagcactttttctcatgaatgaattgctttgcggccttttccttttgaaaactttcatcgtcggaaataggttccccaatggctttcattcatttactcaagtgcctggagtttccatgatgcttcaaatcactttttcggcaatcgtttatgttccggcaaaaggtttgcttttcagctgcctgaacgggcggagggcattcgccaattcctttttaatgaaccggttgcgctcaccgttctgggcttttcgaaatatacgcgtgaagacggaaccaatcgggatggttgagtctcctgcaatcccaaactgtaagggctttccttccttacacttgcagtatagcatgggcagccgaaaaaagctgtgtcgaaattgttaacgttttcacatttcaaaaatataaaagcagtgcggacaaaaccgcactgctttccgtcgttaaaccagtttatgcgcataccatttggcacctttgaagcggttcataaaaatgagcccgcgcacaccccattcggcaatcatcgcgacccagacgccaatgatgccaaaaccgaatgtaatccctaaaatatagccgagtatgacccgcaaaagccacattgacagcagcgaagcgaccgatgtaaatgttgagtcacctgctgcccggagcacggccggcataataaaactttgcggccataacagcggctgcccgaacgcagaaatcaggacaatcgtaaagatcgtcggaataatcgagtcaggcggattaaacaattgcatcatgacagggaaaaacggcaaaagaaccgctgtcgttacaacataaagcagcgaagacaaaacaataaacgactttgcaaatttccgtgcgtcatcgatattccgccggcccatgcattgtccgacaatcgtgacaatcgcaatgctaagcgcgttcggtcctatctggaagagcagcgtgattgaacttgcaatcgcattttccgtcaacgccaatgtcccaagctgcacaataaatgtctgtgtcagcagtttcccgccgttaaaaaaaatttgttctgccgcaaacgggatcccgataaacatcactttcttcaataaagaaaagtcgaggtgaagcgcatttttaattttaaaacgaatcgtctcattgtacttcatgacataaaaaatggaagcgatcatgccgaaaacccttgcgcataaaatggatgtcacaaggccgacgacgcccatatgaaaaatggtaataaatacaacattgagcacggtattcgttaagttcataaacagcgacaagccaaggcatggctttgtttccccgacgccgcgcaaaccgcccagtactgcctggaaaatcgcaataaaaggataggagagacagctgccaatcaaataaattctcgcattatgaaaaacggctgcatctgctttcccgaacagtaaattgagtgtcggcgtgttgaacacaatcacaaacacggcaagcacgaccgaaaaaatagcaacagcagaaatggcttgtgtcgcggtctttgacaccatttctttattgccgattcctttatactgggcaacaatcaccgttccaccggttgcgatcgctataaatacgttgacaaggaaaatattcaatgaatctaccatgtttacggcactgacagcactgacgccggcagaactgatcatcgccgtatttagaaaactcattaagatcaaaaacgtctgatcaaccaaaattgggataataatgccaataacttcccgataatctatagaatcccccgttaaatatctgttcaggtaaaaagtagacttctgcttgagtttgacagctttgatttccataagacctctcttcttcattttgcgggctttttcatccgttcttttgaatgcaacccatattatatcaccttgataaaaagagtaaagctttttcgcctggcgaaatttacgattttgtgaatagcaggtaacccggaaaacaagcgccagcaagccaaatgaggcctgaaaaactgtattttttcatcggtagctattcaatttttgacgcttcatttccatggtgatacgatagacatgtaaggggttacataaatgggaaagggtgtatgatgatggactttcaaaatatcaccattgcagggagcggcgtactcggaagccaaattgcctatcaaacggcttttaaaggctttggtgtatacgtttatgatatttctgccgaggcaatcgaacaggcaaaagaaagaatttccgggttgaaggcccggtaccagaaagatcttggtgcaacagagcaagaagtgaatgaagcctatcatagaatttctttttctgatgatctggggcaagctgtagccaatgccgatctggtcattgaggccattccagaagtggtttccattaaaaaggatttttaccaaaagcttggaaaattagcaccggaaaaaacggtctttgccacgaactcctcgaccctgctgccaagccagtttgcagaagcaaccggccgcccggaaaaatttctggcgctccattttgccaatgaaatttggaaaaacaatacagcagaaatcatgaaacatcccggtacaggtgaaaaagcgtttcaggatgtgattgcattcgcagaggcaattggcatggtggcgctacctttgcacaaagagcagccgggctatattctgaactcattactcgtaccgctgttggaagcagcccaaatgctgctggtaaaaggggttgccgatccggatacgattgacaaaacatggcgcattgcaacaggcgctccggccggaccattccaaattttggatgttgtcggcatcaacaccgcctacaatatcagtttggcaaaagcagaagctagcggcgatgaactgtataaaaaaatagcagatttgctgaaaacggaatacattgacaaaggcaaactcggaaaagaaacaggagaaggcttttataaatatccttccaccgattcctgatgtgaaaaaaaggcccacacaaagcagggccctttttattttgtcttatttttatagtgatcccgaaaaaacttaattcaaaagccgcagccatggatagaaaagaatcaacctatatctggcaaacattacagcacttgctgaatgggccggataaaaagtcaaaacggatttgttcagcaagccctgtttaatgcaccgcaactttctgcccatggaaggccaaatattggacggcttccggcggggcgatttcctgcatcatgtcgacaaggcgctgatgatgcgtgaaaaagatgatttgcgtgcagctggaaagttcgagcaatactttcaatgtttcttttgaacgttcatcatcaaaatgaacgaggatgtcatcgacaatgaacggcagcggctcgttttcagctgcgtatttttcaatgctcgcaagacgtaaggacagatacagctggtcggtcgtcccatcgctcatcccgtttagcggcacattctccccgccgcgcacgcccattaaaacaggctcgtcctgctcgttgtaatccaccgccaacccgtcaaaagaatgaagtgtcagccgcgcaaaaatgtcacccgcacgatttaaaatcggattttgattttggctccggtaaaattcaatccctttttgcaacaaagcggcagcgagtttcaactggatatattgctccgtcaaactggcgatttgcgcatgcacgctttccctttcctggccggcttcaatggctgtcatgttggcgccgcgaatctgttcttcgtattcttttttgaccgccccatattcctgctccacctcggaacgcgaggcttccaaacggtcaagttcacgcccggtttccgccaaatcggcgtcaatcgaatctgcatcaaaccgggccgcctcatcaagcaattcctgcagtgatttaccggcacccgcatccagcatgtccgcttcgatttgccggatttctttttcaaaactttttttcagcaggaaagctgtttcaatttgctttagttcttcgattgtgctgcagcctgcctgttggaaaagttctgttaaaaccgcttcagctgcttccagtgcttctgtttcttcttttctctcattctccaagtcttctaaacggcgtttgagctttttcaaagcggcatcgtcctgtttggcattttgcagcagctgatacatccggtttacggcaacagcggcattctctccgttcaatggaagttgggccgtttcaaggatatgctgcactttttcttcaaagcgcgccattttttcagtaacggcttgctgctctttttcagtctggttgtatgcatcatagagttgcatacatgtttcatagcgggcgagcagggattcagcaaccgccggcggcacctcttccaatattgccgtgcccgcgacagccgaagaccaatttgccagccatgcttcgcgtttcttcccgatttccgctttctccgtttgcatctcttcccgtttttcttttaaatcgcggatagccgtttcgaggctgtccttctttgcggcaagattgcggactcgtttcaattcgttttctgcaaggcttaccagttccgcaagcggctgcccttctgaaacggcggcaaatgttttcagcacggcagaaagcgcattgcagcagtccgcacggctatcatggagcgcgcgcattttttcttgcgccttctcataatcctgcatcaagcttttaatttgcgcgtgtttttgcagccattcccgcatctctccaggcgtaagcggacggatttgcgccggcgcccaaagattttgccaggcggattcccacgcacgcaaagcttcttcaagcccggatttctctttttcaagctgttcttttttcccgcggaactttctaatatcggctaaaagtttattcttctcgccgactttttccgcttccagccgcatcgtatccgcaatctggtcagcttcaaggacatgtttctcataaaccgacgcggccggctctccctttgtatatgtttcagccgtttcaagccaatggccggtttcaagtttggtgcgtatcagctgccagccggcatcccttaaggcacggacggccgacagcttttcttcggacgggatctcggcaatggaatcaagccggcggatgctttcttctgaagcttcgatgtcctcttccaaccgggaaatccggctttgcaccgagtccagctgccgcgtcaattgctccgcttctttttcaaactttttcaccgtttcttccaaaccgggcaccggaagtttgacaagttcttccaccccgccatcccataacggcaaagcacggacggcttcttccacttgccgctgtttttgccggcattccgcgtccagctcgtgtatcgccgcttccacgtctcccgcacggttcaccttggtcaggacggcttccagtttttccacgtccggtagatcaggcaaggcagccaattcttccagcttctttgccagctctttttccagtttttcgccttcccgtttcaatgattcataagcctggtcgagcaacggcttttgcttgcaaagctcgcggatcatttctttttgggcggaaggcagccggtaatgttctatattttcaactgttgcacggcccgggtcgatctccttcataacggacatcaattgggcttggagctgctgctttttcccttcgagctcaggcagcattttttcatcgtcttcgtactgttgcacttggcggtaaagggctgtaatcgcggcagcctgttctaaaatgtgttccggaatgctgatttctttcatttccgcttcggtgcccgccagttgccgggaaattttgtccaagtttgcccgggaagcgttccatttgttttccgcttcggcacggacttctgcaatattatccggaagatccgggacatcgccgagcgcttccaatttttgcaaaagatttttccggtttgcgatcttcggcaaaatccatttgacccgttgcagctgttctttttggctgcgcagcgtctttatttttgcggtgagggcgccaagttctttttccaactcccggtaacgcgccttgaaagctttccatgtctgtactttcaactgctgctcattgatttttttcgaaagctctttttcccgcttgagcagctgatttaattcagggacggaaccggtttttttgtacagcgcgcctgcctgtttgtcaaagttctcgagaacccggcgtagcacattgatgcccgaagcggcggtgaaaaaactttccccggcattgcccccgctttccaaaaggctttcgccaccttcacggagacggacatggtcaagggcaaacatatttaaaaactgggattccggcatatggtttaaaaaagccgcgaccgtattttccgggaccgggttgccgtccgggtcaagtgccgtattctttttcccttttctgcgggtaaactgcaaggcttccccttttgtgttgcgcaaaagcccttcaattcttaatttcgtattgccatggaggaaagcgtcgttcgttttttgcggaaatccgtataaaaaatgcgtaatcgagcggagtgttgtactttttccggcttcgttcggcccgaacagcagatggaagtttttctccggatcaaaggaaaacatctgatctgtaaaatgcccgtaagcaagcaggttcaaataatcaaatctcatgccttttccgcccccgtttccgttaaggaataaagaatgaagtcttccacatcttttatccgctttttgacgaggccagggttggaaaaatcaaacccgtcttccccttctttcagttcatgcggaatggcctggcggatatcgctgaattcatccagcagcgcttcaagcatctcctcatcttcggccgtgctgcggataaattttagcaccgtcccgattggcgattgttcatcggaaaaggcatcggcatcgttcagccctgttgtcttgatttttactttctccacccagatttcgccgaaacctgtctcaagcgcaatggaacgcagctggttcaagaggaggtctttttttgcaatcagttccctgtgcattttcgttgcgccggccaattcaaaacgcaccgccaagtaacgcccgtctgcttccgcatatgccttttcaagcgcactgcgggccgcgtccatgagcccgtccaccgtttcgatgtcgcccatatcaaccgggcataatgtccagcgcaacacatcaagcgggatgggttccatcttttcaatcgtaccgtcttttacttccacataggtgcagcccttttctcctgtctcccggatatgccgtccctggatatttcccgggaacaaaatcgccgggtcatgcggatggagcaattcccgcatatggatatggccgagcgcccaataatcatactgcttctccatcatatcttctatcgtgcacggcgcgtaattttcatgcccttcacgccccgtcgcgcttgtatgtaaaatgccgatattgaaatagccttcttttttcggcggatagtttttcacaagattttcttccactgcccgttgtgcaaaaccttgcccgtgaatggcgacgccaagcgcatcaagggtaaccgtttccggcgcttttaccggaaattcgtggacattctccggcagtttcagagatttcgtcatcaaattggccgcatcatggttgccgcggatgaggaaaacaggaatgccttctttctgcaggcgcaccatctggcttgtgaaaaagaggccggtattgtaatctttccagttgccgtcatacaaatcgccggcaatgatgagaaaatggacttgccgttcaatcgccgcatccaccaaatttttaaatgcttcacgggttgcaccgcggattttttccactggtgctccctcgtattgctccaggccggccaaagggctgtccaaatgaatatcagccgcatggataaatgaaaaagacaaggcactccctcccgaatttaaaaacgagaacatttatttgctattttcattttacatggacagggagggaatgatcaagagaaaaaccgtttttctgaaaaatttttatatttcggtaggtttttttgcaagtcgttgtagtttaaacagaggagttacgcccggccgattcccagtttatattgaatatcgttcaccagtttttggtatcttttttcttcccggagagctgcaaaaacgggattttcctttactctcctaccacctgcatcagaaaagggcggacagttttagctgtccgcccttttctgaatcgtccggtacgtgcgcggctttaatcacgggagatgtacgctgcttcttttgcttcttttgcttcttttatttttgcatacgtttccgtaagcatgacggtgtcctccacaagccggctgatgcgcaagaggacgtcttcattgacaatttctttctggtaaaaatctttttcctctataaaaacataagactggacaatttgtgcccgcatgtaagacaaaatcggcttgatctgctgctcggcaatcaaataatgtttcggtgagccggccgtgacaatgatgcttgccaccttatcccgaagtgatttttcgggcagcaggtcaaacacatttttcaatgtcgccggaatcgatgcctggaaaaccggcgtgccgatgataagcgcatccgcgtccatgacagtttgcgccacaaatttggtatccccttcgtaatccatataatggcgcccgtcgctgaactgcacatcgtaatccgccagatcaaggagcgtgacttccgcgtttggatatttcccacggatcacgtttaccgcgtagttcatcgctgttcttgttttcgagccgactcgcgagcccgaaagtgcaacaatcttcatttatgctccccctggttctttgctgtatatttttcaatgccggtaaaaagtccgccgatttctctattttttcaaacagcctgtgccggccgggattgacagactgccggcgttattgctgttataccttttctgtaaactgctgctttgttcttttgtaactattataatatgaaaaaagaacggttgcacttaatcgcgcttcggaatcggctccggtacatttcaaaaggctgtccaaatgaacagcctttttctttccgtttatttttctgtctctttcaactgatcgagatattgcatgtcttcactggaaatttcaaagtctacgtccgcattttgcaggataaatgcctcatgcgtcgattttgggagtggcagcacgcctttttgcaagcagtaacggatgcaaacttgcggaagtgttttgccgtatttgtctgcaattttttgtatctcggtgttttccagaatttttccagtagcaagcggcgaataggcctcaaccagaatgccattgtcctggcagaatgctgtcacatcttcctgtgtatgtccaatgaagtaacggatttgattgaccatcggcttgatttttgcattttccatcacggctttcaggtcggaaacgctgaaattggaaacgccaattgcccggcagcgcccgctttcatagatctcctccatcgctttccaaacttcaatattttctttcgtgtaatcggcccccttttcgctccacggccacggggcatgaatcagataaaggtcgagctgctcaaggccaagattttccattgtttcgtcaaatgttttcagcgctttgtcatacgacttgatttccgccggcagcttggacgtgacaaaaatgtcgcgccggtcaatgccggaatcccgcactgctttgccgacactttcttcattatggtaagcataggcggtatcaatgtggcgatagccgttttttaaagcaaaagatacggcatggtaagtggtttcgccattcgggacttgccatgtaccaaggccgattttcgggatcgccaccccattttccaatacaaaagtttcatgtagacttgacatatacattcctcccaattttacaaaaatggtttatactacagcaccggccgtttcggttgcagcctatgtgaaggaactacgatttttttgcttgctttctttacataaaagcgctctatgttaaggaacatcaatttttttgcgcgtttccttcacgtagacgcactctatgttaaggaactacgtattttttgcgcgcttccttcaagtagacgccttctacgttaaggaacagcgatttttttgcgcgcttccttcacgtagacgtctaagttaaggaagcgcagaaaaaaggaggtcttccttcacgtagagcccgtctaagttaaggaagcaagcaaaaataaaggcccttcttaacatagagcccgtctaagttaaggaagcgaggaaaaaagaaggtcttccttcacgtagagcccgtctaagtgaaggaagcgtggaaaaaagacggcctttcttcacatagaacccatctaagttaagaaagcgcgaaaaacgaaggtcaatcttaacatattctaatcattgaaacagctttcaatcacaaagttttcctatattttgcatttaaagtttcacaaaatcctcagcatcccttgccgattctgtaggttttgcttattcagcaagccctatttcatgtgcaaatttttactctgccgtgttccatgacgaagcaaacaaaacagtttctgcagccgccaagcagatgcaggcatatccgggaaggatggaaaagaacgataagagttacaatttcttacaatccaaattttttcttaatttgttatatttctatattgataaattttcaatgaaaagtataatagaattatgcaattatccaaaaattcttggggaggatgagaaatgagcatctttcagacaaaagcaatcgcaaaccttgtagaagggacccagggcaagcaagggctgaaaaaagcgcttggtgcactcgatctcactttgctcgggatcggcgccattatcggcacagggatattcgtgctgacaggtgtggctgcagcaaactattccggccctgcactcgttatttcctttatcctgtcggggctcgcatgtggatttgctgccttgtgttatgcagaatttgcatcaatggtgccggttgccggaagtgcttatacttacgggtatgcggcgctgggtgaattttgggcatggattatcggctgggatttgattttggaatacggcctggctgtttcaaccgttgcgatcggctggtccggatacgccgtgaacttgcttggaaatctcggagttcatctgccaaaagcgctgacgcttgcaccgatggacggtggcattgtcaacctgccggccattctcattatcgctctagttgcctggctgttgtattcaggggtccagcagacatctcgcctgaacggcatcatcgtagccataaaagtagccgttgtcctgctgtttgtggtgcttgctgtcgcacatgtgaaaccggtcaactggcatccgtttatgccgttcggatttaaaggcgtgctttcgggcgcagcggttattttctttgcttacatcggctttgatgctgtatcgacagctgcagaagaaacgcgccgcccgcaaaaagacgtgccgcgcggaattttgttctccttgttaatttgtaccgtgttgtatatcatcgtttccgccattttgacaggcgttgtcaaattcagcattttcagcaggccggaagctgcttctgctcccgttgcgtatgcattgcagcaaattggcattcactggggtgcggcactggtttccgttggggccatttgcgggattacttccgtattggttgttatggcatacgggcagacgcgtgtattgtttgccatgtcgcgtgacggacttttgcctaaaattttttcaaaagtcagtgaaaagagaaaaactccagcgacttcaactgttttggtcggaatcgtcaccgcgatcacagccgggttcctcccgatcaatattgtggctgagatgaccaatattgggacgcttgctgcatttgtgattgtatgcgtggcagtcattgtgctccgctataaacgcccggatctggaacgtccgtttaaaacaccgcttgccccggttataccggctctcggtgcaattacttgcggcatattgatcgcaagcctacagccggcaaccctgatccgcttcgttgtctggttcgcaatcggcatggtgatctacttcggatacagcatccgccacagtgagctgcaacaagaagcgaaaaaaacagcgtaaaaccaaaaatagatggcctgtttcaacaggtcatctattttttgaattttttgcgttttattatttatcgttcacaacaatgtaagccgctttgactggcccgtgcacgccgacgatcaagttcatttcaatgtcagcagagttgcttgggccggtaataaaattgatgcatgacgggacggtttccccgtttttgatcttttcgcggatctgtaaggcggcctgcgtcatgcgcgggacaatcgtgcttttcggtacaatcgcgatatacgtcttcggcagcaggctgaccgaccggccgcgttctttgctgctgaacaaaaccactgtgccggattccgccaatgtgatatcactgaacgtaatcccgacattcgctttttcgcacagcgcaatatttttttcgccgatttcgggatcccagacatgggtttcgattcccatttccggccagccttcctcaatcagcggggttaagccgaattccccgaaccgcttgtcattccaaagcgagacaggcccgccgccgtacagttctacgacttcgtttaattttccgggcaaagtttttgcatccgtttcaaaaaaatcaacatggacactgagcgactgctggcgcaatacttccagcagttcctcctggtttgcatttggcagtacatcatattgcggcttatgcttgtaatccggacgggcaacgccggatacaaccggtttgcggccgagcctgccggcaatattatttaaaaatgcatcccggttttggatggctccgttcattttttctgccccctgtctttctcccgcttttcaaaccagtcacggaaaggttctttgttcggcgcagggaaatcgcgcacatccgtccacggtttcatcggccccggtcctttatggatcaaatcgtcttttaaaaacggacggacgactttggaagccatttttgccccggccccgtaaagtccaggttttgaagcgccgacgccgaacgctttcatcaacagccgttctgctaccggtgagcgtttttctttttccgcgatcacttggcggtgcttaatcaaaagctcatgcagcggaattttcaccgggcaggcttctgtgcaggctccgcaaagcgaagaggcgtacgggagttctttgtatttgtcgtatccgcctaaaagtgggcttaataccgcgccgatcggtcctgggtaaatggagccgtacgaatggccgccgatattccggtaaaccgggcatacattgatgcaggctgcacagcggatgcactgcagcacctgttggaattccgtcccgagaatatcggaacgcccgttgtcgacaatcacgaggtggaattcttccggcccgtcgacttcgcctgcttctttcgggccggtcacagttgtaatatagctcgtcagccgctgaccgaccgcgctcctcgttaacaggctcaccaaaacttcgaactcttcgtaagtcgggacaagccgttccatccccatcacagcgatctgtgttttcggaagggttgtgaccatgtcggcattcccttcatttgtgacaaggccgaccgaaccgctttcggcaatggcaaagttacagccggtaatcccaatttccgccgataaaaattcttcgcgcaaaactttacgtgcaaacgcggccagttcctccggtttttccgtgccggtatagccgagacggtcgcgaaacacgtcgcggatttgatctttgtttttatgcaaagccggcgcgacgatatgggaaggatggtcgccggccacctgtaaaatgtactcgccgaggtcggactcgacaacagtgctgcccgcttccatcagggcttcattcatgccgatttcttccgtcaccatcgatttcgatttaatcacttttttcgcgttttttttctgcacgacttccttaatatactggctcgcttcttcagcggtctgggcaaagaagacatggccgccgcgttttgatacattttcgcttaattgatatagataatagtccagattgtttaaaacgtgttggcgaatttcttcaccgagcgaacgccattcttcccagtttccgagttcattggctgccgccagccggttggtttgcagccgttcctgggcactgcggacggcaccacgcataaaatcatcgttgatgccttcttcgaccctgcctttaaatttttcatcactaatcgataaacccatttttttcacccctttgccgttttttaatctctgctgttcaaaacttctgcaatatgcataattttcatcggtttgcctttacgcgtcatccggccgccaatattcattaaacagccgcagtcgccgccgattaaaacgtcagcaccggtttcttcgacgtgctccactttttcgtccaccatttgctcggagatttcgctcattttcacggagaacgtgccgccgaacccgcagcatgacaatgcattaggcagtggcacaaattcaaggccgtccacatgttttaacagtttcataggcgcgtcttttactccgagcaggcgcgtcatatggcatgatggatggtaggtggcctttgcgtgcaggcttgccccgacgtcttccacttttaatacatccacgagaaattgtgtaaattcgtatgttttcgcagcgagcgcttttgcttttggttcccacaccgggtcgcctgcaaaaatttccgggtattctttaaacatgtatgcgcatgagccggaaggagatacgacgtaatctgcgttttcgaacgctttcatcatttgtttcatcgcaggttttgtatcttccagataaccgctgttataggacggctgcccgcagcaaatctggccttttggaagatcaacttcacagccctgccgctccagcacttccaccattgctttcccgacatccgctttgaacatgtcgacaaggcaagtgatgaacaaactcactctcacaatattcaccttcttaaagtattaggtcaatcatcagatgaccggattacagttattatactccttatagtgaaaacttggcaatgaaagaaatataggttttaaaacttttgccctacgaaacggcagttctgattggtttccattccggaatcgaaaagttaattccattctatatatttattttaatggaaagatacaaataaaacacctgatttaccgctttttctatctttagtgacctttctggagagcccagcctttttagtcaagccgaacagttctcttaacggaaaagatgctgccttcctgtaaataattcaaaaattttagatacttatttacattttatccttgtctctttacgatataaatatatgaacatgtttggaaaggggatgatgatttggtcactttggaaaaacttgtcgaattgcctgcgtttggccggattgtgcttgccgccggaaagtcaggaatcagccgggcggttacgggggtcaatgtgacggagagcgttgattgggcggatttttttaagccgaacgaactacttgtcaccactggggtcaccatgggcaatgatcctgaaaaattggaggagatggtggcgtttgcctgcggtcggcgcgcagccgggattgtcattaacacgggcccgtatattcctgaaattccagaggcggtcatccggtttgccgattcacaacattttccggtttttcaaatgccatgggattaccgggtagcagattttataaaaattaccgtccaatttttgatgattgagcaaggtaaagaagcgctttcccagcaaatacttgcggaactcctttttaacccggggatggaccgggcgtatatgcggaacgggctgttcaaactcggttttggggaagatgcagattacggcatcatcgtttgtacccaggacacggaaaagcctgatatgttgccgtttgcacaaacggtggaagatgttttccatgcccgttatgcgcagtatctggccggcgtttatgaagaccagattatttaccttgtcgaccgttcaaaagtgcggacgccagatatcccgtttgcaagggcagcggcaaaaattcaggaatccatttataaacggaatatggaaagcctgcttgtggggatgggaaatttttaccgggatattgccgggatccataaaagctaccacgaagcaaaaatggtcatccagcttgccaagcgccaagctgtaccgcctatttgcaaatacaaggaaatcggcgcctataaaattctaatggaagtcaaggatcgcgaaaggattgcagggttccacggggatatgcttggcaacttgtaccgctacgatgagttgcacggcacagattatgtccatttcctgaaaatttatttggaagaagacggccagactgctgcgatcagccgccgcgaatttattcaccgcaacaccgtgctgtataaggcgaaaaaaatagaaacgatactggatgcagacctgacccgcagttttacaaagaccaatctttcgcttgcgttcatgattgaagacattctccaatgagtatgtgcaaccgcacaaaataatttgttccaatcatcattacattctgaaaaaaacctttttataatgaggttatcatttacaaaatagaaatggagctgtcaatcatgaatgaagcggagattacgcaaatccagcaagacgatcggcagtatgtcatgcactcgtgggcgaaacaggcgtatgtgcggccaacggtaatcacgaaagcaaaaggcatttttttctgggatgaaagggatcataagtgctatgacatgtgctcccagcttgtttatttgaatgtcgggcaccggcacccaaaattgttggaggcgtttaaatcggtcggggaaattccgctcgccgcgccggcgtttgccaccgcgccaaaatctcaacttgcccgcaaaattgttaaggcggcaccggaaaacatggccaaagtattttttacaaatgggggtgcggacgccaatgaccatgctgtgaaaattgcgcggatggccaccgggcgttataaaattttttcgcgctatcgttcctaccatggcgcgacatttggagccggcaacctgacaggggaatcgcggcgctttctcgtggaaccagggatccccggttttgtaaaatttgaaacaccctatctgtaccgcgaaacgctggattttgaaagtgaggaagcggcgtccgctttttaccttaaccgtctgcacagccagatcctctatgaagggcctgatcagattgccgctgttttccttgagccggttccgggctcaaatggcgtcctcatcccgccgaaaggatatcttgaaggcgtgcgcgaattgtgcagccgctacggaatcctgatgatctgcgacgaagtgatgaccggctttggtcggacgggcaaaatgtttgctgtccagcactatccttttgaaccagatatgattactttcgcaaaaggagtgacaagcggatacagcccgcttggcggtgtcattctcagccgggacgtagcggaatacttcgatgagcatatttttctgactggcctgacctacagcggtcacacggtttcagctcaaattggctgtgcctcgatggacatttaccaggaagagaatctgcttgaaaatgcccgcgaaaccgggggtgtgctggcagaacggctcaaacagttgaaaaaatttcgcgcagtcggagatgtccgctcgatcggcctctttgccgcagtcgagctcgtaaaagataaggaaacgaaggaaccgcttcaggcatatggcatggattacggaaaagatccgtccggccttatgaagaaatttgtagcgctgcttgcagaaaaaggtttttatacctattcgcatgagtcaagtgtgattattgccccgccgctgatcattacagccgaacaggtgaatgaagcgatgaacttgtttgaaacggcccttcgcgagtttgaagagaacgtattgtttcctgcaaatactttaacggtaaaatgaggaaaagcattgttgggatagaaagtttttcaaaaacttcattggcgccggccggtgaactgcggaaaggtaagggattgttgaaatggaggactttttttataaacagcccgtcccgattgatttcggggccggcaagatcaggaagctacctgaaatcatcaaacagacaggcggaaaaaagggcattttaatcagcgccccgtcgatgctcagacagggaattgcgcaggatatcatgaaagaagctggtggtgcgcttacggcggtgttttcaagtattcagcaaaatccgaccgtaaaaaacacggatgattgcgcgcggatgctgcgtgaagaaggagcagatttcgcggttgccatcgggggaggcagtgtcctcgattgcgcgaaagctgctgcctgcatcgcgcagacgccatacagcgcgtctgcgtttctggcaaaagcacaaacgcttgtgcaaccgggcattccgctgatcgccattcccacaacttcagggactgcgagcgaagtgaccaatgtgtcggtcctgaccgataccaaaaaaggcattaaggcgctgatttcaagtgatttcctttaccccgcgtatgctctcgtggatcctgaattgacgctctcgtgcccgaaacatgttacagcgtcaagcgggcttgatgtgcttgcacattcccttgaagcctattatgggaaaaagcaccagccttatacagatatggcggctgaacgggctgcagcgctcgtgtttgaatacctgctcccggcttaccatgaacctggaaatctgcaggcgcgggcaaaaatgagtgaggcatccgtcacagccgggcttgcttttaacatgacgcagacggccgccgcccatgcctgctcttacccgctgactcaggaattcggcattgcgcacggggaagcatgcgcttttaccctgccgtcgttctggcgtttgaacagtgtggaaggaccggaaagcgggcgccttgaagcgttcagccgctgcctcgggttcaaagatgcggacgcgcttgccggtcgtattgatgaaatgaaaaaagaaatggggcttatcacgacgcttgaggaagcaggtattgaaacggaagcagatctggaccggcttgtcgcagcgagctttgcaccaaatatgcagaatagcccagtgaatataacaaaagacaaattgaaagttatgtacagccggctcgcaggcggaaaagttaaactggcttgataaaagcttcggcgttcattagcggtgaacagtagattttttcacaaaaaaataaactgaaaattagcttaaaaataaacattaaaacaataaaaatagtgattttgttttttcagtgatattcaacaaaaggaggagaaaggcatgcagcaacaaaaaatgctggttaatgcacaaaggttacaggaaacgctggaaaagtttgcgtcattcgggcggacgccgaataacggggttacacggttatcattgtcgcaggaagatcttacagcaagggagtacttggaaacttgctgtaaggaaatcgggatggaagtgaaatacgatgacatggcaaacatgtatgctacaatgcccggcaaagaaggcaagccgcctgtggtgatgggctcccatctcgattccgtcaagaagggcggacgctttgatggcgttcttggtgtcgcggcggcattggaagtggctcgcacgattcatgacaaccggatcaaattggaaatcccttttaccatcgtcaattttacaaatgaagaaggggcaagatttgagccggcgatgatgtgctcgggggtcatttcgggcaaatttgataagcaaaccgttcttcaaagccgggatgagacggggatgacattcggagaggcgctttcggcgagcggttatgccggcagcgttgaaaaccgcctgaagaaagcagccgcctttcttgaaatgcatatcgagcaaggtccggtcctggaaagtgaagacaaacaaatcggaattgtcgaaggggtcgtcggcatggtcaattatgaaattgaagtcactggcgaatccaaccatgctggcacgacgccgatgggcatgaggagggatgcattgttcgttgcttgtgacatcatcagggatgttcgtgaacaattgagtatgcttgacccggaacttgtttatacgatggggcggatgaatgtgtatccgaatatccataccgtcattccgaataaagtggtgttcacacttgaagcaaggcacaaagatcctcaagtagtgtcgcaggtggtgagtacaatcaggacgttaccgcaggaaatgggcggatgcacgattgcttcaaaaaaattatggtcccgtgataccgttgcatttgatcagggcattgtcagccggcttgaaaaatcggctcagtcgcttgggatttccgccaaaagaatgtacagcggcgctggccatgatgcgcaatttattgcaagctacctgccaaccgcgatgatttttgtaccgagtgcaggtggcaaaagccactgtgaggaagaactgacgtcatatgaagactgcgcgcgcggcgcaaacgtggcactggataccgtgttgtctttgcttacagggcaataacagcaaatgaaaacggaggggaacggatgaaatcacaaattgaagaaaacggtattgtcatcctgacgaaggaaacggcagaacaattgcagcactcaaacctctggaatgatgacctgcgccctgcaacaaaagaagagcatacctggacaggaaggagttttgcagctttatggatcggcatgtgcctgatcattccttcctatacaatggcaagcggcatgatctcgcttgggatgaactggtggcaggcacttctgaccatttttcttggaaactgcgttgtgctggtcccgattttgttaaatgcgcatgccggtgcaaaatttgggattccttatccggtatttgcaaggctctggttcggatcaaaaggcgcacatattccgactttggctcgtgcgatcgtggcagccggttggttcgggattaatacctggatcggcacgacaagtattgacgccttgatgtcgcgcatggtctcgggctggtccggcctgccttttcataccggaattgtatttctgcttttctgggcgttaaatgttggcattgggatcaaagggcctgaagcgattaaatggcttgccaccatttctacaccggtggttggggtctcgtccataattttatttatctgggcggccacccatgtcaatggctggggaccaatactcacagcgccgagcaagttccagacgacaggcgaatttctcgcggtgttcttcccggcactgaccggcgtcatagccttttgggcaacgcttgcgcttaatattcccgattttgcccgccatgcggtgaaccaaaaatcgatgatgatttcccagtcgtttgcgctgccgctgacgatgacaatattctcttttatcggcattttcgtcacttccgccaccgttgtgatttttggtcaggcactttggcagccggttgatctgctttcaaaattcccgactcttgtcgtttttatcggggccattgttgtcgccatttcatccattacggtcaatgtcggcgcgaacctggtggccccggcccgggcagttgaaaatttatggccgcggcgcctgacatttgcgtcgggcgcaattgtgacaggcctttttgccattgccatgcagccatggtacctcatgtcaaactttcaaaatctgatttacggttttcttggcacatacggtgcgctcctcggcccgattgacggtattgcgatcgccgattactggattgtaaggcgccggaggtttgacctgaaagaactgtatgagacgaacgggcgctacaactattcttccggaattaatacgagcggggtatttgcgcttgtgatcggcattgcggttccggttgtggggcttcttgtcccgggccttagatttttgtgggacaatgcgtggacagtcggaatcttagttgccgctgttgcctacagctggctgatgcgcaatgacaggagtttgttgtcccagaaagcatatgaagacatcaccgtttttgtcagccgtcatgaaaaaggcggtgcggtgaccgcaaccgttgcggaacaaagcaatcaaatataacttgcagggggtgtttgaatggaatctttgacggtctcagccgtgtttaaagaagttcggcgagatttatccgcacaggaagcagtggaagaagcaaaccgttgtttatactgttatgatgcgccatgtacgaaagcctgcccgaccggcattcccgttccttcttttatccggaaaatcgccacgggcaatttgaaaggttccgcgcgtgcgattctggaagccaatccgatgggggcgacctgtgcccgcgtctgcccgaccgaagaattgtgcgaaggggcatgcgtgctgaacgagctttccctgccgattatgattggcgatttacagcggcatgccgttaactgggcgatgcagtccggggagactctttttgaaaaacgcacgtcaaacggcatgaaggttgccattatcggcagcggcccagccggtttatccgcggctagggaactggcgaggcacggctttggcgtcactgtttatgaagcaaaggaaaaagcgggcggactcgatacatacgggattgtcccgttccgccttccccaggaaattccgctctgggaagcggaccaagtgacagctttgggcgtggagattttgacagaaataagggtcggcgaagacatttcagcggaggaaatcctctcccgctatgatgccgtgctagttgcatgcggaatgggaaatgttccgcgcctcggcatccccggagaggagtacaacggcgttttggatgcaattgaattgatcgagaatatcaaagaaggcaggataacgaatgaatttaagggcaaaagggcggttgtcatcggtgccgggaatacagcgatcgatgctgccacctgcctgaagcgcgcgggggcggcggatgtaaaaattgtctaccgcagaaccgaagcggaaatgacggcttacaaaagtgaatacgaatttgcgaagcgggagggaattgaattcagatggcagtggcagcccgcagaaatcatcagcgatgtatccggcaatgttacggcgctttctttgagccgggtcgtgcttggcgcacctgatgcctctggaaaacgcaagatccaggcaacagaagatccgaaatttaagctagaaacagacgtggtggtccgggcgattggccaaaaccgccgtactgatctaatcaatgcattcggccttgtgcatcaccatggtattcttgcagtggatccggaaacttatcaaacttccaatgaaaaaatttatgcggccggagacgttatttttggcatcggccccacggaagcgatggtagtcagtgcggttgaacagggaaagaaggcagcatatgccattcaacgcgccatgcagacgcgttacatgagagaggaggtttagtttttggcaaatttaaacgttgagattaccggcatccgttcgcccaatcctttctggctggcatcggcgccgccgaccaattccggctaccaggtacagcgtgcatttgaagccggatggggcggggtggtttggaaaacgctcggcgatccgattttaaatgtcacgtcccggttcgccgcactttcctatagcggaagaagaatggccggtttcaataatattgaactgattacagaccggccgctggatgtaaacctgaaagaaattactgaaacgaaaaagaaattttctgatcgagcaattattgcctcggtgatggtggagccaaaacgggaaaaatggcatgaaattgtcaaaagggtggaggatgccggtgttgatggactcgaattaaattttggctgcccgcacggcatggcggagcgcgggatgggtgcggcatccggccaggtcccgcagctggttgaacagcagacttactgggtcaaggaagccgcaaaaaccccggtgattgtaaaactgactccgaatataacggatattacagccactgccttcgctgctgtacagggtggagccgatgccgtcagtatgatcaatacaattaacagcctgatgggggtggatctcgatacctggcagaccgtcccccacgtagcaggccttggcacacacggcggctactgcggcccggccgtgaagccgatcgcattaagtatggtggcagaatgtgcccgcgaccctgacatccccgtcccgatttccggaatcggagggatcgccacctggaaagacgcagctgaatttatgctgatgggcgcctccaatgtccaagtttgcacggccgtcatgcaccacggattctcaatcgtagaggatatgattgacggattgaaccattatttggatgaaaaagggttgcaatcagcttcggaccttattggaaaatccgtaccgaaatacaaaaactggggagaactcgaccttaattacaggacagtcgcccgcattaacgaggagcattgcattcattgcaataagtgctatatcgcttgtgaggatacggctcaccagtgtattgacaggctggtggatacttccggaaaaagcattttaagggtgcgcgaagaagactgcgtcggctgcaatctttgctcgcttgtctgcccagcggacggcgccatcacaatgataccgttacgaggggaaatgccgcttacctggaatgaacgccagcgaaaaatatccggtcttgaagccgacgaaatcacaatcagttaaatggagggaaatacatgaaaaaacttattaaaaatggaattgttgtaaccgcagcggacacttatgaagctgatttgctggttgatggggagaaaattatagaaataggacgcaatctcacagcagatgatgcagaaatcatagatgcaaagggggcttatatttttccgggcggggtcgatccgcatacacacctagacatgccgttcaacaatacggtaaccgatgatgactgggaaaccggcacaattgccgcagcattcggcggcaccaccacgatcattgatttctgccttacaacaggggatgatacgttggaaaaagccgttgcgcgctggcatggcaaagcggagggcaaagctgccattgattatggtttccatttgatgcttgccaatctggatgaaaaggtgctggaagaattgccactcttactggaaaaagaaggaatcacctcgctgaaagtttttatggcatacgcaaaagaattccaagctgatgaccgcaccctgttccgcgcatttaaagccgcaaaagaagcaggcgcgctcgtaatggtccactgcgaaaatgggagcgtcattgacgaactggttacaaaggcgcttgcagagggacacacggaaccgatttaccatgctttaaccaggcctcccgaagcggaaggggaagcgacacaccgggcaatcgagctggcccacatggcggattcccagctgtatgtcgtccatgtcacctgtgccgaagccgtcaagcaaatcgccgaagcacgcgccaaaggatacaaagtatggggagaaacatgcccgcaataccttgtgcttgaccagtcttatttggaaaaaccggattttgaaggcgccaaatacgtctggtcgccgccgctccgcgaaaagcatcaccagaaagtgctgtttgacgctttaaaggccggcattttgcaaacccttggctcggatcaatgctcttttaactttaacggaaaaaaacagctcggacgcaatgacttttctaaaatcccgaacggcggcccgtttatcgaagaccggttcagtatttttttttcagaaggcgtgaaaaaggggatcttatccttgaaccagtttgtggacattgtttccacccaaccggcgaaactgttcggcctgttcccggaaaaaggaacaatagctgtcggggcggacgcagatctcgttatttttgatccggaagtaaagcgcgtaatttctgcaaaaacccatcatatgaacgtggattacagcgcgtttgaaggcatggaaatcacaggagagccaatctctgttttatgccgtggcaattttgtcatcaaagacaaaaaatttattggccagccgggaagtgggaaatatttgaaacgcaaaaaaattaaccagggtgctctgcagtccccgacagcagccacagtgtaaaaggaaaaaatgatgcgcgaatccattttattcctgaaagaaaaagcggagattgaccgtctgctggattgcggatttcgaattacagcggtagaagaggacctgaacggttctctggtcacctttacgaaagaaaaccgatgctcagtgcggcagatcgtgaccacggaaggaagaaagtattttccattaaaaatttgatccatcggaaacccgattgcttgatgcaatcgggtttcccatttccagaaaatctattccaaaatttattttaacgaattactaatttaccactttactaaactaaagaaacacgctaaaataaagtcataaattttaccgagaacaacacagagggtgaacatatatgaataaaaaatggggactttggacattaaccacgttcgtcgtcggtaatatggtgggcggcggggtcttcatgctgccggctaatctcgcaaataaggccggggcgctcggttctacacttgcgtgggtgctgaccggttttggcgttttgatgattgcgctcgtgttcggaaacctggccatccggaaaccggaactgaaagcaggaccgcaaagctacgcacagtcgctttttaaatcgaaacaggcaggccgggtcgccggctacagcatggcatggggctactgggcagcgaactgggcggcaacggcttccgtcattatttcgtttgcgggttatttaacgacatttttcccgattatgcaaagcacgaaaatcctgtttacgctcggatctttccaaatggagaccggaaaatttttgacatttgctgtgtgtacagtcatgctttgggggattcaatcgatcctgtcgcatagctttaacagtggcggaaaaatgaatcttatcgcgacggtcacaaaagtactcggctttatgatgtttatcgtcattaccgtttttgcattcgatgccgcgaacttcggcaatgcgaaagcttttaccgatgcggacggccacgccgtttctctcttcgggcaaattaacggcggcgccatctccacattgtgggcgtttatcggcatagaatcggcagtgatgctgtcaaaccgcgccaaatcacaaaaagatgtgaaaaaggcaacacttctcggcctgttgatctcgatcctgatttatgtcggcattacactactgacaatgggcgctttgtcccaggcggaactgcgcgtttcacataaaccgcttgtcgatgcgctcggtcaggtgctcggtgcaaacggccagtatatattagccgcactggcgctcatttccttgtttggttcaactgtcggctggattatcgtcagctccgaagtgccataccaggcggcaaaggccggcctttttccggcatttttcgggaaaacgaacagaaaaggatcaccgtcccgttcgctattggtaacgaatatcatgacgcaaatctttttattctccactgtgtcggacaccatttcggaagcgtacgattttgccattgtcgtggcaacactggcctatttgattccgtatcttgtatcggttatttaccagttgaagctggtggcagccggtgaaacttatacgtcgctaggcgctcgcacaacagacggtatcattaccggtattgcgctagtgtattcggtatgggttatcattaccggcactgccgatttaaaaacgttcttcctcggcatcgggctgtttgtcatcggcctggttttatacccggttttgatgcgggaaaataaagtatataaagaagtgttggagtaactgcaacccgttgggaagactgcttcctgacggggttcctttgcttaggctagtcacccggccacctctattgcgagatgattcagaagtggaggcggattgtaacccccatttcttaggttcctttcttggccggtttccaacggtccgccactatgaccagttgattcaagtggaggcgggttgtaacctcatttcgattcttgtgccagtttccaatgggccgccgctattgcgagatgattcgtacggagacgggttcaacccccgtttcgcattctccattcatgtaccggtttccaatggattgacactatggccagatgattcagaagtgggggcgggttgtaaccccatttcgattcttgtgccagtttccaatgggccgccgctattgcgagatgattcgtacggagacgggttcaacccccgtttcgcattctccattcatgtaccggtttccaacgggccgacgctatggtcagatggttcggaagcggaggcgggttttaatcctctcatttcgcaggctcccatcaaaaagaaaaggatgccctataaaggacatccttttctttttacaaactcatcttcaaaatttcccgcacatcttccttgcccagttttttaaagttgccgatcgggccgaatggcaaagctttttctgccatgacgtcgagcttgtcatcgccgatattgtaatctgcaagccggcttggcgcgccgatttcgttaaagaaagcgcggactgcatcaatgccagcaagtgcaatttcctcatccgttttccctgcaggatccacgccccatacctcaacggcaaaccgtttgaaacgcgggatattttctttatagacgtacttcatccagttcgggaagatgatcgcaagcccgccgccgtgcgggatatcgtaaacagcgctgacggcgtgctcgatcgagtgcgttgcccagtcggtttccacgccggtcgcaagcaggccgttgagcgcaaaagtggagctcagcattaagtttgcgcgcgcatcatagtcctcaaggttttgcagcactttacgcgcattttcgatcactgttttcataatcgtttctgcaaaaccggtttgcagcggaatttcttttgtatgcgaaaaatattgctcaaatacgtgcgagagcgtatccgaaatgccgtaaacagtctggttacgcggcacggtaaacgtattttccgggtctaaaatcgagaacgtcgggaaagtcatgcttgctccgtgtttttgttgcgtttcccagttcgtaatcaccgagcctttattcatctctgaacccgtcgcagccagcgtcagcacagtgccaagcggcagcgctttttccactttcgcctttctttcgtaaaaatcccatacatcgccgtcatacagggcaccgcctgcgattgctttcgaacagtcgatgacgctgccgccgccgacagcaagaatccagtcgagttcattttcgcggatcagggagatgccttttttaacggtggacaggcgcggattcggttcaacgcccgcaagttcgcgcacatggcagcctttcttctcaaaaattgcctgcaatttgtcatacaagccggaacgtttgatgctgccgccgccatatacaagcaagatccgttttccgagctggtcgattttttcatcgagcttttcgagctgcccttttccgaaaatcagttcagtcgggttgtaaaacgtaaacgggttcatccaattcccttctttctttggagttttacagacagattgtaccacattttaggatgcgccaatcattttaaaagcttgcatgaggaaaacagtccttttcgtttaaaatttgaaagcgcgttctgatcggtatgtaagaaaacctgacaacaaatataaaaattttaaaaaaattaacgaaaaagtattgaaaaaatggctgacatcacatatgataatttatataacaaagatgcgttataaaatctaacatcagaaaggaagaggcaaatggttcctgcagattcggtctttatgtttgtatcgacggcgcttgtttgggtcatgacacctgcgattgcgctgttttacggggggatggtgaaaagcaaaaacgttttaagcaccgcgatgtacagcttcggttcgcttgggattgtatcggtattatggattcttgttggttattcgctggcgttttcaaccggcggcaacgcgattctcggcgatttaagctgggcggggttgcacgatgtcacgtttaaaccgaatgcagattacagtgcgacgattccgcataacttattcatgatgttccaaatgacgtttgcggttttaaccattgccattatttcaggcggttttgtcggacggatgcggttttcggcatacttgattttcatttccttatggtgcgtgctcgtctatgcgcctgttgcccactgggtatggggcgttggcggctggatccgcaaccttggcgcactcgactttgcaggcggcaatgtggttcatatttcttccggcgtggcggccctcatcctcgcgcttgtgctcggaaaacggaaagaatccgagaccggacggcataacttaatgcttgtcctgatcggcggcagtctcctttggctcgggtggttcggatttaacgtcggaagtgccttatcgttaaatgaagttgccatgtatgctttcatcaataccaatactgcggcggcttgcgggttaatcggctgggccgcggtggaatggattgtcaataaaaagccgacattgtcaggcgcgatctcgggcggcattgcagggcttgtagcgatcacgccggcagccgggtttgtaacgccaatggcttcgatcctgatcggcctggttggcggcatcgtctgcttctggggcgtcacgtatttgaaatcgaaactcggctatgatgatacgctggatgcattcggcattcacggcatcggtggcacatggggcggcattgcaaccggcctgttcgcctctaaagcggtcaattctgctggcgcgaacggtttgttctacggtgatccgtcgctcgtctggaaacagctcgtcgccattgtgtccacctatattttcgttggtattgcctcctttattatcatcaaagcgatccaattgtttatgccgatccgtgttgatgaagaagcggaaaaaagaggtcttgatattacgttgcacggcgaacatgcttacggccagccgtacgaagatgcggtttacgaacaggctgcagcaaaataatagaagaaataccagcccctttccaggctgccgggacaatcccggcggcttttattttgcttagattgggaacgcggtttagcgcatcatgccattttcgccgcaacatttccaaaaatcatgtaaaatgaagataaatcctttttggcgggggatggggatgcgtaaaagaaaggtttcattgcagacaaaaatactggggcttgtgctgcttctgtcttttttgatcatcggcacgatttccggttattttatggtgctggagcagcgccgaatcgaacaacaggaagggcgcctggcgttaaatattgcgaaaacggtggcggcaatgccggctgttgtgaatgctttccaaagcaaagatccgtccaaaacgattcagccgcttgcggaaaaaatccgcaaagaaaccggcgccgagtttatcgttgtcggcaacagggaagggatccgctactcccatccgctcccggaccggattggcaaaaagatggttggcggtgacaatgaacgggccattttgaaaggggaatcctatatctcaagcgcaaaaggatcacttggcccgtcattaagagggaaaacaccggtacgcgaccggaacggaaacattattggcatcgtgtcggtcgggttcatgttaagtgatgtgaatcggcagaccaacatgcacatgatgaaagtggctggcgtcgcactgctcgcttttttcggggccattatcggaagcgtgctgcttgcccgggatatccgtaaagacacaatggggcttgaaccgttcgaaatcgcgtcgctttacaaagaaaagcgggccattttacatgcggttaaagaagggattattgctgttgaccgggaagggtttgtcactaccatgaatcagccagcgaaaaaaatgctgcatattgacggatcggtcaggcgtacaaagattgacaagctgataccggcttccattttttacgccgtgttaaaatccggcaagccgcaaaaggaccgggaaatggtatggaaagaccggacgctcattgtaaacagtactccgattctgaatgaacgagggaaagtgcagggggcggttgcttcttttcgcgaccgttcggaaattgaacgaatggccaatacattgagcgaagtccgccaatactcggaagatttgcgggcccagtcccatgaatacgcaaataagctgcatgtcctttccgggctgttgcagcttggggcttatgaagacgcaattgaatttatcagggaagagacggcatctttgaaaaaccagcacgcccgtgtttttgagaagataaaagacatgaaagtccaggcggttttgctcggcaaactcggcaaagcatccgaaaaaaagattcattttgatattgatccgaacagttctttagaaaggttgccaaagcaaatcgatgtgatgcggctgattgtcatgcttggcaatctgctcgacaatgcttttgaagcagcgggaaaaaccgatcacccggccgtcttgttttttgcgacagatatgggggatgacattgtatttgaaatcagcgataacggacctggcatggaagaagcggtcctcgggcatatatttgaaaggggttttacaacaaaagcaaaagaagcgaacagagggtttggcttatccaatgccgcccatgctgtgtcagaactcgggggtttcattgaagtccacagccaccccggggaaggaacggtttttacggtttatttgccgaaaagggagggtgtcgacagttgaaaacaataaaagcggtgatcgccgaggatgatttccgggtggcgcttgtccatgaaaaatttctggcagagttcccttgtttcgaagtggttggcaaagccttgaatgcaaaagaaacgctggcgcttgtggaggaaaagtctccggattttttgcttctggatgtatattttcccgaccggctcggtgttgatctacttcctgacctgcgggcattgtcgccgcatctcgatattatgatgattacagccgctgcggaaaaggattttatcgaaaaggcgcttcattatggggtggaacactatttaatcaagccggtttcacttaagcagtttaaggaggcggtcgaaaagtatctggataaaaagcgcctcctggaaacagcgggtacggtggatcaggcctgggttgattcgctgttcgggtcgccacgccgggaagcggggacgcaggaaacggagctgccgaaaggaattgatgcgattacgctgagcaaagtaaaagcagtgctaattccggaccaggggcagtccgccgaacaggtcgctgaaaaaatcggcgcctcccggacaaccgcccgccgctatttggaatacctggtttccatccggacgtgcagagcagaagtcgaatacggcatcgtcggcaggccggagcggaaatattatcttgtttaaacgcctgtacggcaggttgtgaaaacgagggttacaaaaaatggaaatcgggttttccataagtgttgggaccgtgacgggatactggggagtactgggtacgtgttgctcttgcacgaggctcaccgaccattagatcggccggcttcgttagcgagtactgggcacatgttgcttttgcacccttcccccttttctgttcgtgaacaaaatgaacaaaatagtcaaaatagattttataccaaatatgttgaaaacgcttacaatggttggttcattgggtaaactgaaagaaatgaacgaaggggtggctgttttgttggcgttcatgggttttttgatgattattgttttcatgtttttgatcatgacgaagcggctttccgccatgattgcgttgatgttggtgccggtcatttttgcggttatcggcgggttttggaaaggaatcgggaagatggcgatcgagggggttacaagcgtcgcgccgaccggcattatgattttatttgccattctttattttggactcatgatcgacgcggggttatttgacccggtgatctcgcaaatattaaaactcgtaaaaggggatccgctcaaaattgcgatcgggacagcggttttagccgttttggtatcgcttgacggggacggcacgaccacctatatgattactatatccgcgatgctgccgctttaccagcggatcggcatgaaaccgctcgtgcttgcgggcattgccgtttccggatcgggcgtgatgaacctgctgccatggggaggcccgacagccagggcaatgagcgcgctcggcctcgagacgtcagatctgttcacgccggtgattccgtctatgatcggcggcttgctatttgtctttctccttgctttttatctcgggcgtaaagaaagaaaacggctggggatcatcagctcagaaaatgaagcaattttggaacaggctgcagcagttgcagtcggtgaggggaatgaattaaagcgcccgaaactcatttggttcaacggccttttgacgattgcgctgcttgttgggctcattatggaagtgctgccgacagcggttttgtttatgctcggttttgccattgcggcgatggtcaactatccgaatatggatgtccagaaagaaagggttgcagcctatgctggaaatgcgatgtcggttgtggggatgatttttgcagccgggatttttacaggcattttgtccgggacaaaaatggttgatgcaatggcaaacacattgattacccacgttccagcagcctggggaccgcattttgccgtcatcacggcagtcatcagtgcaccgtttacctttttcatgtccaatgatgcattttattacggcgttctcccgctcgttgcaaaagcagcagcagcgtacggcattagtgcggaggcaattggcagggcatcattgctcgggcttccggtccatttgctgagcccgctcgtcccatccacctatctgctggtcggcatggtcggtgccgagtttggtgatttgcaacgtgctttcttaaaatgggcgtgcgtatcggcactcgttatgatcattgtggcattggtgattggcgtgattccattttgaagcaggaaaagcgaaaggatgatgtgtgcctttcgcttttttgcacttgagggagcctaggtttggttccggttcttacaggctggtctgtgattttcgcggctcttttcgtaaaatgacctgaaagaaaagaagcccgtgtttacgcgttcaccgaggtgatttgctgcatacgaaaacacggcttcccaaaaaagcgagatagaaggaagcggcggggtggaacaagccaaccactgcttctgatacgacgtaaaaagcgacaacaggcttgtcaattaatcctttttgccgaatcctgctgtgtccgcaacaattgctggctgattgtctcctgctgtgcatcctgcgcaatcgtgtagcgcggacgcctttttgtttcctggtaaattttaccgatatactcgccgattaaccccatactcattaacataaagccgcctaaaaaccaaatggagatgataatcgaagcccagccgtcatccgcatggccggaaatttttacaaaaagtgcatacaagccggcgatggtgcttgataaaaaagtaaacaaaccgacaagggtaataaagtgaatcggcaccacactaaaagaagtaaggccgtcaaaggcaaacgccagcatttttttgagcggatacttgctctcgccggctgcccgttctttccggtcgtaaagcacttcggccgtttgcaagccgattaacggcaccacaccgcgcaaaaataaattttgctcagggaagcgggaaagctcctccagcgcacgcttactcatcagccggtaatccgcatgattgtatacgagatcaacgccgagttttttcattgcccggtaatacccctgggcagtcgctcttttaaaaaaggtatctttctcccgctttttccgcacgccgtacacaatgtcacagccgtcgtgaaacttcaatagaaattcgcgcataaccgagatgtcatcctgcaaatcagcatcgatggaaatgacacagtcagcctcttcttttgctgtttcgagcccggcaagcagcgctttttggtgcccgaaattgcgcgaaagcttcaatcctttgacaagccggtttttccttacaatttcctcgatcatcgtccatgtctggtcacggctgccgtcatcgacaaacaaaatactgcttttcgggctgatcaggccttcgttcatcaaggaatacaccatttccgtcagctggcgttccgtttcgtataaaacagcttcttcgttgtaacagggaacgacaatggtcagtactggattttccacgttagcaacctccaacaaacagtattacggataggttttgccagcgtgcatcactttatgcttgaaaaagggaaatgaagaaaaagaatggcaagatgagagattatgcggtcttctctataaaataacttaagtttttacatcaaccccgagcacccatttggcatgagtactactttttgtggcaggcaacagaacggaaaaaaacatggaatggcaaaagagaacagaccagacattggaaaatcaggtggaaacgtggtatactaagatgcggagtgcaacggatggggaatatatattttaccatcttaattatatcatctcctcatcccattgtcaaatttattggcttgcggtgctacatttttccctactggttgggatgccggggtataccgcttcatgccatataaaatgaacttatgttttgacatcaagccaatttgcatgatgactacttttacagcaggcaacagagctaagatagtttgttcatttttttaagaaaaattttctatactcttactgtcaggaaggggccggttctatgccacacgatgaagaatggttaaaggaacaaaaacgcgttgatgatacaattgaaaaaatgaagcacgaaaaggatacactgctctccaaagtaagggctgtccgcggcgaggcacaggaaatccgcaatacgttctgggaagacgtaacggtgaacctcgatgagccggatgatgtcgtagaaacatcggcgagcgtccgccagcaggcagaactccttgctgaacgcgaacgaagctatgggcatatggaaaaagatgtgaaaaaacttgatcgcctcatttattctccatattttgcccgcgtcgattttcatgaagaaggggaaccttccgagcccatttacatcggcattgcttcctaccgggatgaggatgagtatctcgtttacgattggcgtgcgccaatttccagtatttattatgacggagtgcccggcccggtttcgtaccaggcgccggacggcaggcgcgaaggcatcatggatttgaaacggcagtttttaatccggcgtggccatattgaagcgatgtttgataccggtgtctcgattggcgatgaaatgttgcaggaaatgcttggagcaaatgcaaatacccatatgaaaaatattgtggcgacgattcagaaagaacagaaccggattatccgtgatgtttccagcaatcttctgttcgtgcaaggggccgccggaagcggaaaaacatcggttgccctgcagcggattgcgtatttgctgtaccgttaccgcgattcgctccattccgagcaaatggttttattttcgccgaaccagctatttaatcattatgtgtcaaaagtgctcccggagctcggggaaaacaatatgcagcagacgactttcctggaatttgcccaggcacgtgccggcaaaaagctaaaagtcgaaagcctgctcgaacaaatggaagaagcgctcgaaggcaaagccgaaaataggaaagaagcacaaatcaaaggcagccttgcctttttccatgcagttcgggattatgtggaaaaacttttaaacggcggcatccttttccgcgatatccgttttaaaggcgagacgatcgtggcaaaggaaaaaattgctgagatgttttatgcctatgataaaagttactcgctgtcgaaccggtttcagcttgtcagcaaaaagctgctgaaagaactggaacagattgcaaaagaagagcggaaaaagccatgggtggaagaagaaatggaactgctcgggacggaagctttccttgccgctcatcaatatgccgagcgcaaatcgcgcaagagcaatgatgcgttcagcgagtccaattatgagaaagaatttctggcgcgtaaaattgtcaaccgccgcttcagctcgatccgaaaacaaattaaaacgtttcattatctccatatccgtgcccagtatctagactttttacggcgcgcaccagaatttgttcccggtgcggaagaacggcttgatgtaaaaacgcgcgccgctttccgtgatggctggttgccctatgaagataccgtgccgtttttgtatctctttgaccttttgacaggcaaagctacgagcagttcgatcaaatatgtgtttattgatgaaatccaggattattcgccggtccagcttgcctatttgcgctatttgttcccgtacagcaagtttacgatgctcggtgacttgaaccagtccatattcggcacaagcggccgttcgcagatggagctgattaaggaaattttcggtgaagaaaaagcgcaggtcgtatacttgacgaaaagctaccgttcgactgcccagatcacccgctttacgaaagaaattttagcgggcggggagaagattgaatggtttgaacgcgaaggcgatttgccggttgttgcggtggcccgcggcaaggaagaagctttggcaaaagttgtacggtttgcgaaaaagtacgcaaaagatagcaataccgttgcgatcatcggcaagtcacggaaacagtgtgccgaagcgtatgaaacattgcgggaagaactggatctgacctttattgaaaaagaatacagcgatcttccggaaggcatcatcctgatcccgtcttatcttgcgaaggggctggaatttgacagcgtcatcgtgctcgatgcttccgcgtctgtgtataaagatgaagcagaacgcaccctgctatatacagtcgggacgcgggcaatgcaccaccttgcccttgtcagcaacggtccggtgaccccgcttttagataaagtgcccgagacgctatacgtaaaggaataagaaacaggataacaacggccggctgccaaacgcatcagccggccgtgatcttttccagtaagtaaatcggaacccacgttctatcatgtttgcgatgcggaagcaaatggcggggacctttccacctgttttacggctttcaaagggggggcttgtttttttttttaaaatcagtgatggtgtggcgaaacagacatccttgttcgcgaaatttagcaggagttttgggatggggtgcagaaacattagaaaaaagaaaataccttttatagggggaacttatggaaaagtttattaaaatatggaggagtacttatatttggcttttgatctttctaccggttcttttattcgcaactttcgatcatgtccatatttcttttttcatcttagccttttatttctttgttcaccttatcatagaattttataaaaaagttgcagccaggcaaaaaattggcactgtctgcttgatcttgatttttctttattttagctttgtttattgagaccaccaagacagttgcccgggggatttcgtgtatggagtcacagccacaaaactttgacatctatagaccgggtaacggcttttgttatcgacggttctctttacgctcgaaaccttagtaaatctgttgaacttctggctaaagtattcccatcactgctttatgggagattccaaatactgacaaggaattgaatagacagctcttcatttatacctgttgactctgttttaatgtgctctgcctaaaaggaaaacggatcccaatctggataaacgcactttcggtttcaaacgccagcaagcgtcctccaacctcgtggtttgcgatgctaataaaaaagcgacatggttttggccatgttgctttttaattcagttcgctatggctgattccaaaaaaatgtagtaacgatgaccggcacaataacagcaatcattagaacagcaagattcccaataatgctaattactttcatgaagccgccacctttgctactaaaggcaagaattaatccaataatagggaacacagttaaaatgatgattgttatttgcccaggaaataagtccacacctccataaatagaaactaaataaaccaatgccgaaaaaatgaagagtgcaaaagatattccttcaaattttttcacaaaatttcccctctcttttttgttaaatatttgttgagcaggtgaatcccgcagttcctacggttagaagccttatgacctcgtttttaagattgatacttgcggtttatatggtgggtattagatatggcaatttggccattcccatactgccaggtttttaacgtctttattttggtagcttgtagcatgaacacagctgggaactgggaaaggttttgaatacagctacttgatccatatgggttgaacgggattttagaggtatgacgaatatgtcgcacccaatatttttcaatcatttttaaatatatcaagcagaatatgagatccattcattggatgatcgtggatcgtaataaagtaatgctgatcagaatatattttccactctttaggcccctcatcaaagataatttccaaaaaaatatcgccatcatattttttgttattttcagctaatttttcgtaaacatagggtacccatacttctccctgcaattctaagcttcgatatccgatttccccaaaccaacaattaaaagtccttcgcaataaccgataattcctttcaccataatcgtttttggaaaataaacctcgaaaatcaaatttttccgctagccaatattgaatatcttcttcctgtatatcagagcgcaaacattccctccatatttctttacccttttctaaaaaagacttcctatcaataaaaccttcgctttcaagaggcagatagggaaacttattaccctcattttccaaattggtataagcgttatgaatatagattaaaaaattaaagttataagaaatgacatctcctacgttgatcacaatattccccttttctgtatggtgttggggcaccgatacttcagcattggatacgatcccaattttataagctaaaggtatcaccgcttatcttttactattttcttttggatacaaccagcctgacaattaagtaaccgggttcttattttttctggatagatagctggtaagagtaaaaccaccaagcaatagaatgcatagagctaagatcatattctcaattgaaacagactttataccaagtacagccattactcctaaagcagctattacaaaaatcataatccaaaaaagaaatattctgttatatttttttcgattttcgatagtacgttcatcttctactacttcatcatcgtcctcttgtttttttaaatccctattatattcccagactacaaagatcataactacatcaccaacaagtgaccaaatggggaagggatgctcaaatatagcaacaaatatattaattaaaattacagtagcaatacataaccaaatatttattggctttcttttataattagacggcactgtcttcaccctcctctaaaaagaatatttcttctacatttttgccgaaaaacttagcaattttaagcgcaagctcaagactgggattataacggtgattttcaatcgtaatgactgtttgccgcgtaatttttaattcttttgcaagctgttcttgcgttatcccgatttcttttcttagtaacttaatgttgtttttaaccatagctgagtagctcctgatatgtataagtttaaatgatttttcctttcctcaataaagtaagagtatctttacaaccagtatatccggtttattcaaaaatgtaaacatatttttacgtaaaaacatctttacatcaatgtctttaccgtttttgtttgaaaactcaattttggggatgcaaaattacctataaaaaaaacctatttcaaaatatgttgcttttaaaacccgatcctatacaatatacacgtggaaaatggcctaaactgaataaaaagagagctggcttttatgcaaccaaatgagccacttggtctgattcatatgcccttagctgcgcgaaacattcactcatctttttcacgatgacagcagaaaatgaaaaattcccggggacagtcccctcaaaagacacgattcacacacagccgggaaaatcttgacatatacacaatgcgtaccggcccatcgtacgtggtaaactaaatttgcataaacataaggaggagaaaaaatggccttttctcaaagaattcttccggcttctgtcaacatgaaggagtttgaaaggtttttaaaaagtgattatgaaatcgggatttttctggagcttcacatttcacagctcaaatatgtcgcggcaatggcaaaggcggaaggcaaaaaaatgatttaccatgtggacttgatccagggcttgaagagtgatgattacgcaacggaatatttatgccaggagtatcaacctttcgggctaatttccacgaaagccaatgtcatacaaaaagcaaagcaaaagggagtcgtgtcgatccaaagaatgttcctgattgattcgcatgcgcttgagaaaagttacaaattaattgaacggacgaaacctgattatattgaagttttgccgggaatcgcgccatggatgatcaccgaagtaaaagaacggcttggcattccaatttttgcaggcgggttgatccgtacgcgggaagatgtggaaaaagcattgaaagccggagcggaaggcatcactacctcggacacggaattgtgggaagcctttttggaaaagaaataaagataagcggctgttccgggcggccgcagtggtttttttgcatgggacggcacccgggtgtacagcgggcatattgacaagccgactcctaaccagaagtggaagcgatgtgaaacattctcccattggagccgaatgcagcccagcggaatcctaagtctgctggcaaggatgtccgcttctttcaacaaaatctggaaaaatccggtatatatttttttgtgaacatggattgacaaaatttaaagtaagcgttatcatcatacataagttaataaacttggcaggagaacaaagagatccactccattcgcaacaaatttgcgggcgtcgtgggtttttttgttctttttttgatgaaagggaccggattattgccggatcagcttttaattcattcgaaatggaggaaggggtatgaatccatatttagcagaattggttggcacagccatcctgattatttttggtggcggtgtttgtgccaatgtcaatttgaaaaagtcatttgcctaccagagcggctggattgtcatttcgttcgggtggggacttggcgtcgccatggcggcttatgcagtcggaaaatacagcggtgcccacttaaatcccgcacttaccgtcgggcttgcatttaacggggattttccatggtcgaaagtggccgggtatattttggcgcaaatggtcggagccatgatcggcgctgccgtcgtattttttcactttttgccgcactggaaggagacggacgatccgggagccaaacttggcgtattttcgaccgggccggccattccaaactattttgcgaatcttatcagtgaaatgattgggacctttgttcttgtgctcggtgttcttacgatcggggcaaataagtttacagacgggctgaacccgttcatcgttggcatgctgattgtagcgatcggggtttcacttggcgggacgacgggttatgcgatcaaccctgcccgcgaccttggcccgagaattgcccattttctgctcccgattgcagggaaagggccttcgaattggggttatgcgtgggtgccggttgccggtccgttgctcgggggttctctcgggggcgttttttaccgggctgtgtttaaaaatgattggacgcccgcgttttggtgtgttttgctaacgtgtttacttgtattattgatagtatggatgatagaaaacaagaaaaagagagcgtaaggaggaaacgggatggagaaatttattttatccattgaccaggggacaacaagttcaagagctattctttttaaccaaaaaggggaaattgtgcatacagcccagcaggaatttcatcagtattttccacagcctggctgggtggaacataatgcgaatgaagtgtgggcatcggtgctcgcggttacgacgaccgttttaacagaagcagatgtagagccgaagcagattgccgcgattgggattaccaaccagcgtgagacaacggtcgtctgggataaaaagacgggtcatccgatttacaatgcgattgtctggcagtcgcggcagacagcggatatttgcgctgacttaaaagaaaaaggctatgctgatatggtccgtgaaaaaacagggctcctcatcgacccgtatttcagcgggacaaaaatcaaatggattctcgaccatgttgacggagcaagagaacgcgctgaaaaaggcgagctcctgtttggcacaatcgacacttggctgatctggaaattttcaggcggcaaagcccatgttaccgactattcgaacgcgtcccggacacttttgtacaatatttacgatttgaaatgggatcccgagctgcttgaaatgctggacgttcctgctgcgatgcttccggaagtcaaaccttcctcccatgtttatgcgcaaactgcaccgtaccatttcttcggtgaggagattccgatcgcaggcgtggcgggcgaccagcaggcggcgctgttcgggcaggcgtgctacgaagaagggatggcgaaaaatacgtacggcaccggttgctttatgctgatgaataccggcgaaaaagctgtttcttccaagcatggcttgctgacgacgctcgcatggggtattgatggaaaagtcgagtatgcccttgaaggcagcatctttgtggcagggtcagcgattcaatggctgcgtgacgggatgcgcatgatcaaagacagcgctcaaagtgaatcgtatgcagagcgggttgattcaacagatggtgtgtatgtcgtgccggcatttgtcgggcttgggacaccgtactgggaaagcgatgtgcgcggctcggtgttcgggctgacacggggcaccacgaaagaacattttatccgggccacgcttgaatcgctcgcctatcagacgaaagatgtgcttgctgcaatggaggcagattccggactgccgcttaaaacattgcgtgcggacggcggcgcagtgaaaaacaattttctcatgcagttccaaagcgacatgttaggcgtgccggttgagcgcccggttgtgagcgagaccactgcacttggcgccgcatacttggcggggcttgcggtcggttactgggaatcgcgtgaagaaattgcccgccagtggaaagtggaacgcaaatttgaaccgtcactcgcggaaaaagaacgcgaagccttatatgacggatggaaaaaagcaatccgtgcaaccattgcctttaaatagatttgcagattgctgcaggcagcgcggtaatctggcttagcctgcgaccaaattgggcagtcatacggaagtgggcatgcagtaggcaacgtggtttatctgggttaacctgcgacccaaattgagcagctgtacggaaccgggcatgtagtaggcaacacgggtaatctggcttaccctgcgaccgaactgggcagccatacggaagcgggtatgcagtaggcaacgtggtttatgtggcttaccctgcgctagcattgctgttgcaggcggcccctgcttttaaaaagcttgcagggataccatggcaataacaccttggattctgggtagctgcaatactagcaggcaactaatagttttgcgtaagcttttacgtagccagctattgcgttgttatcgctcatcgttctggcgccattgcgtctatgttttagccgcaatactagcaggcaatcaatagttctgcgccagcttaacctgtgagtttacgtggccagctattgctttgttgcctcgcatgattcgggcgccattgccttctatgttttgatgcgctgccttatctaacggggcaacggcaagaaacggggattactacattttcccggtgcataacagctgaaaatcagtggaaggtctgttataataaaaacaagttcataaaatgtcaagagatgcagagagacctggcttgttttatgggagttttccataatgcatggttcaggtctctttttattttgaaggaggggacgaaaatggaattttcaggaaaacagcgcgggacagttttacaaaacatgaaggataaaacgttcgatctgcttgtgatcggtggcggcattacaggggccggcattgcgcttgacgcagtgtcgcgcggcatgtctgtagcgcttgtcgagatgcaggatttcgcggcgggcacatcaagccggtcaaccaaacttgtccacgggggcctgcggtacttgaaacaatttgaagtaaaaatggtggcggaagtcggaaaagagcgcgccatcgtttatgaaaacggcccgcatgtgacaacgccggaatggatgctgctgccgttccataagggcgggacgttcggcgcatttacaacgaatatcggcttgcggctgtacgactttttagccggcgtgaaaaaaacggaacgccggaaaatgctgtcggcttcggaaaccttaaacaaggaaccgctgatcaaaaaagatgggctgaaaggcggcggttattatgtcgaataccggacggacgacgcgcggctgaccattgaagtgatgaaagcagcagtcgcacacggggcgctggctgtcaactatacaaaagcggaagagtatttgtacgaaaacggccgtatctcgggtgctactgttcgtgaccagatcagcggggaaaccgtaaacgtgcgggcgaaaatggtcgtcaatgcgaccgggccgtggagtgataaaatgcgcaataaagacgggaaagggagcaaaagcctccgcctcacaaagggcgtgcatattgtgtttgaccaaagtatctttccgctccggcaggccgtgtattttgatacgctggacggccgcatggtgtttgccattccgcgcggcggcaaaacgtacgtcggcacaacggatacattttacgacaaagacccgattcacccaaaaccgctcccgaaagatattgattacttattaaaagcgatccactttatgtttccaaaagtcaaagtgacagcccgtgatgtcgaatcaagctgggccggcgtccgtccattgatttacgaagaaggaaaagacgcctccgaaatttcgcgtaaagatgaaatttgggaatccgacagcggcctcgtgacaatcgcaggcggcaaactgaccggttaccggaaaatggcggaaacggttgtagatcttgtagcacgcaggcttggcggcaattttcagccgtgccaaacgaagcacttgccgatttccggcggtgatgtgggcggctctgaaaatttgccggcgtttgtcaaagcaaaaacaaaagaaggcgaagcaagcggcctgtctgcggaagcaagccgggcgattgcggaaaaatacggcacgaacgcggatcacgtatatgcatatgcgaaaagctggaaagacgactatccgctaccgcgggaagtgtacgccgtattgaaatatgcagtggaacaagaaatggtggtaaaaccggtcgatttcttcattcgccgtaccggtgcccttttcttcgatatcaactgggtccgcaaatggaaagagccggttatagcatggatggccgctgaattttcctgggatgaagagacagaacaggcgtacaggaaagaattggaagaagcattgcgggaagcggtcccggaagtgtaaacttgttccgggaaagggcacagaccttggtggcgaaaaaggattggttgactattcatattggaagcatacgtctcagctttcttgcaaagacagctggaaaaaggcagcgggcactgttccgctgcttttttgcgctttgcttgcaccgatattttttaaaagcaaaatttttttaatataaaaatagtgaaaacgggataaacctgtactataatagaaatatagttcgtgacgctaaaatgtaagcgcaaacagaggggatggaaaatgaggatcaactttcggaatcttacagtacaagtcattatcggcatcattctgggtattattgtaggacttgtttcacctaaattcggcgcggaactgaatattctcgcgcaatggtttattaaactgatcaaaatgctcgtcccaccgattatcttctttacggtcattatcgggatcggcggcatgggggatttgaaaaaagtcggtcgaatcggcggcaaggcgcttatctattttgaagtcgtcagcacggttgcgctcgccatcggtctgattatcgtgaatttgatccaacccggccacggcattgatacaagccatgcgaaaacaagccaggtttcacaattcgtcacgcaggcaaaagacagcgagcacggttttatcggttttatttccggtattattccggaaagcatcgccggggcttttgtcaagggagatcttttaccaattttattttttgcggtactgttcggggttgctgccgcatccctcggggagagggcaaaaccggttatccgcttttttgaagacatgacggaagttttctttgaaattgtcggtattgtcatgaaagtgtcaccgatcgctgcattcggggcaatggcctatacagttggccagtttggcgcaagctcgctgatcaatctcggcgaattaatggggtctgtctacctgacgatgatcatttttatcttgcttgtcctcggcgggattgcaaaagcgtttggtttcaacattttcaagttcatcgcttatataaaggaagaacttttactcgtgctcgggacctcttcatcggaatcggcgatgccttccctgatgagaaaactcgaaaaattcggttgttcaaaatcggttgtcggccttgtcgttccaaccggatactcgtttaacctggacggcaccgccatctatttgtcgatggcatccattttcattgcgcaggcgtataatgtgcacctgacgatcgggcaccaaatcatgctgctgctgattttaatgctgacatcgaaaggggcggccggcgtgaccggttccggtttcattacccttgctgcgactttgtctgcgttcccggttatcccggttgcagggattgcgctgttgatcggcgtggaccggttcatgtctgaatcacgcgcgctcacaaatattatcgggaatgccgtcgcgacggtcgtcatctccaaaacggaaaaagaatttgacaaaaaggaagcactggaaacggctgcccatcctacagaatcgattccttcttaataagaggcgctccgattggggccctcttcttttttaacattggctttggagaatacgcggggtaattgagagatagttgcactttattgaaggaaggataagaggcgttccgaggggggacactcttatttttttaacattgactttgactttgggcggtgtgcttatttttgtgtacaatagggtgtgttgagggatttgtccagcaggccgcctgcagctacgtaatgatatctatgaaatttggagaataccgagtaattgagggataattgcactttattgaagaagggaagtgagcgctttggaaaacctgcgtaaaatgccgctttttaaaggactcggggacgcggatctggctgtgatcgccgatatatctgttaaaaagcatgcagaaaaggatgcgcatatttttttccagggggacccgcaggaagccgtttattttattgaaagcggggaagtgaaaatttaccgcaccgatgcgaacggcaaagagcaagttgtcacactgcttcgcgatggcgacatgttcccgcatgttggttttttccgtaaaataagctacccggcgaatgcgatggcggttgtagacacgaatctcgttgcgatccggattactgattttgaaaacgtgttgctcaacaatccgcagctgaccatgactttatacggtgtgatgagtgatgaaatccttgacttgcaggaccggctcgaagcccagattttaaacaacgcttacgagcaagtagtcaaactttttctgcgcctcacccgcacacatggcgttcaggaaaaagacgggtttgtcctcgtgaaaaccccgctcaacaactccgacctcgccaacatgatcggcgtcacccgtgaaacggtcagccgcacgatccgccagcttaaagaaaaaaacctcattctcccgcaggaaaaaggcacatacttcattcaccaggaaaaactgacagaggaactgctcggggtataaagattttcccgccggtaagaattaaagcaaagaaagacaagggggcgtcgtgggagcgaaatgtctttcatcggggtgatgaaggacaaaagagaggcgtccaggcagcgaaatgtctttcattggggtgatgaaggacaaaagaggggcgtccgggcagtgaaatgttcttcatcagagctatgaaagacaaaagtgaagtgcccgcgcagcgaattgtctttcatcaaggtgatgaaagacaaaagggggttgcccacgcagcaaaatgtctttcatcggagttatgaaagacaaaagagagctggaatccgagcaaattgtccttttgggggattcaaaaagacaaaagaaagccggacccggggtgaattgtccttttggaggtttcaaaaagacaaaagaaagccggacccggggtaaattgtctttttgggggcttcaaaaagacaaaagagagctggaatccgagcaaattgtccatttggaggtctcaaaaagacaaaagaaagtcggaccagaggcaaactgtctttttggaggtctcaaaaagacaaaagaaagccggacccggggcaaattgtccttttgaaggtctcaaaaagacaaaagagagctgggatccgtacaaattgtccttttgaaggtctcaaaaagacaaaagagagctggaatccgggcaaactgtccttttggaggtttcaaaaagacaaaagaaagccggacccggggcaaattgtccttttggggggttcaaaaagacaaaagagagctggaatccgagcaaactgttcttttggaggtctcaaaacgacaaaagaggaacgcacgcgcaacgagttgtctttccccggggccaggaaagaaaaataaaaagcaaaccgcccctttttaaaaggctgcctgggaggacagccttttaaaagtcaaacggcttcttcgagcaaccgcttaaatagaatattattctccaggtgaatgtgctggaatgtatcattttcaaaattttcaaggcggtggtatacgagctggaatgtacggcatgccccttccggcaacgtatagtcattcgtaatttcgcggagccggtgcaaaatttccccgacagcagcatgttctgtttcaagatcggtcaaaacggctgtcgcggctttcaggttagcggcagttggaaggctttcgtatgcacgaatggccgggaattgttcggtatcttctttttcagtatgctccagcagttctgtttttaattggttaaacagttcatgcacttcgatgagatgcgggtggttgccgccgtggacacgcatcacttttgttacatacgggctcaagtttggcagttcctcgcgcaaaaacgcgtgatgggtggcctgaatatagttgacaatttccgtatagcccgcttcattccaattttgctcagtgccttttccggcatattggccataaaggttgcaaatagcatcaagtagttcatctgctgataggttgcgcttttccgcagcttctttcacagacacattgccgccgcaacaaaaatcgatacgatttgctttaaacagatccgccgcttttgggaataaggttacgatttccccgacagtctggctcgttgtaaaacgttccatcgaattcactcctccatttcattgctgccttcatcataaaccatcagcacctgcttatttgtgatgcacatcacagcaattgaggaaagttcttatttatgttaaggaagcgcgaaaaaacgaaggccttccttcacatagagtgcgtctatgtgaagaaagcgtggaaaaatgacggccttcctacacatagaaggcgtctacattaaggaagcgtggaaaaacgaaagcctttcttcacatagagtgcgtctttgttaaggaagcgtggaaaaatgacggcctttcttcacatagaacccgtctacgttaaggaagcacgaaaaaaagatgtcctttcttcacatagagtgcgtctaagttaaggaagcgcggaaaaaagacggtctttcttcacctagagcccggctatgttatttaatagaaaaaaagcatcccaaaaccttggccataagaagcatgatctgcccaaagaaaaaagcgccaatctaaattggcgcctccgcaattattctgctttgcttgcttctaattccaccgtaaatttgatttcatcgccaacgaggacaccgcctgtttcaagggctgcgttccaagtaaggccgtaattgctccgttttacggtcccttctgcactaaagccggctgtttccgcgccgctcatcgggtttttcgaaatcccttcaaatgtgactttaaatgtttcttcttttgtcacgccatgaatcgttaaatcaccggtaacgttataatcattgtcccctgcctttgtaaccgacttggaaacaaatgtaatattcggatattgttcaacatctaagaaatcagcagaacgaagatgattatcgcggtcatcatttttcgtatgaatgctcctggcatcaacaataaaagaaacttttgcatccgttaaatcttggggatcagcttcgatttcggcttcgaaattttgaaaagacccttttacttttgaaatcatcatatgttttactgtgaaatcaatggtgctatgtgcatagtcaactgcccattttgtttttgtcatcctaaattcctcctgtttttaaaacttacttttcgtaacttagtttaatatcgtaagttaaaaaagtcaagaaaaccgaaccctttttttaaaagggttcggtttctgaatcagcaggtaggcaacatcctgcatgttaatggtgctttttgcactttcttttgcagtatagtggttcttacaccaggcagaatcctgcattgttaacggtgtttgcgggaaccaattcgggcacgccgtaagtcgcgcaaaagccgcgtgctgaaaacccgcagcaatgcgtgtcaatcaataactggagaaggtaggtaattccagcccaaaaattgcatgccaacttatatataatgatgcccattccatcgcatccatatactccggctctagctctaggccagattaggcaggtgcagccattcattccttgaccattacatatgcttcacttcagttgtcaaccgagcttcgcggcgcagccaatcatttctggacaattgcgtatgctcaattcgatcgccaactgggccccgcagtgagccattcattctttggcaattacatatgcttcaattcgatcgccaaccgagctccgcggcaaagccattcatttcttgacaattgcgtatgctcaattcgatcgccaaccgagcttcgcggcaaagccattcattccttggccattacgtaaacttcaattcgtgtatcaaccgagcctcgcaagcgcagccattcattctttgacaatgccgtgcaacatgcagatgtcattctgcaaacgggaaccagcccggcgttgagatgatcatcttccacagcggttccggaataacgagccgttcgcggtcgtcttttcttaacgcggtttgaattgcatcctcctggccggctttaattttttccacccaatgcggctccatgacaagctcacggccgagggcaataagcggtacatcggtttccattgccttcaaaacctcgtctcctgtgtgcagggagccgacgccgatcaaaggcacgcggcctgcgacatgttccacgatctgttccatgcgcggacggccgggttcaccgccgcggcgggctttagaccagaagtgctgcagggaaatatgcacatagtcgagctctttttccatcagcgcatccaaaagcgcgaacgtgtcatccatcgtaatccccggttcgtacggttcttccggggataagcggtatccgactaaaaacggccggtccgcatattccgccaccgtttttttcacagcatcgacgacagcaagcgggaatgcaagccgtttttccagactgccgccccactcgtcttcacgccggttcgtatacggggagaaaaattgttgaatcagatagccgtttgcaccgtgaatttcaacgccatcaaaaccggcttcgatcacgcggcgtgttgcttcgccaaatgccttcacaatttcagcggtttcttctcccgtcaacgcgcgtgcatggacactgccatctgacgaatctgtttcactcgcgctcacaacatctccgcccggcacgagttcagccgggcattcgcggccaccatggtggatttgcacaaccgcttttgcaccgttttgctgaatcgtttgtgccagttttttcatgctctcaaccatttcgtctgtatgtgcgccaggttgcccggtaaacgctttgccgttttccgtaacattggcacatgccgtcacgaccatccccggcccttttgcacgttctgcataataacgcagctcagcatccgaaatcgtgccgtcatcattcgaggaataatgggtcatcggcgccatcacgatgcggttttccgccctgacgccgcttttaaacgtaatgggttcaaacagtttatcgtatttgctcatggtcatgctcctttcctggttgctttcgcttttttattatgttccaatctgtaaaaaaacgaaaatgaaaagcaccgatcaaaccatgcaggcatatcatataggaaagtattttttacatcatgaattgggagacgtgaatgatgagtgatgtccttttactgcttcaaatggtggcaaaaaggttgagtatcctttcgttgattacagcggtattgctgttgttgtcccatttatggctgtacgctgtattcgcgttcatcataatgggcggcctgatttgcgttgaccggatcattagtgaaaaaggcaattcacgggcagcggaaaaccggcgctattatactttgatcgttgtaacagatgaagattggtacgaagaagagcatgtgccgtttcttgaaatggatcatgtctccttagagctgcattatcaatatgaagatatccgtcgcattaatccgttgatccagctgcaggcgtttcccggatttgttctcgtcgaaacggatgatacaaaaagaatagaggaatcgttgcaaaacccggcgctcgttacgggaaactatgcggaagtcatccattttctgaaacaggaaagcgcggcggaaagctgaaaaagaaacggaatccaaacaaagccgatgcccatttgttgcgtgaaattgcttgggagaagtctttttccgaaacaggaagtgcgactggaaagctgaaatagatacggaaatccaagcaaagccgatgcccgtttgtctcgaaaattgcgtgggagcggtctgttttctgaaacagaaagcgcggcgggaagctgaaaaaactgaatatcaagcaaccatgcaaagcccgatgtctgtccggagaggatgctttctaaaacaggaaacccgcaccaaaagagcagtctgtattccgaagtgcggcggaaaacggaaatagacacggaaatccaagcaaagcaaagatgatactcatttgttgcggaaaatgcatgggagcagtctttttccgaaacaggaagtgtgacgggaaagctaaaatagatgcgggaatccaagtaaagcaaagccgatgctcgtttgtctcgaaaattgcgtgggagcggtctgttttctgaaacagaaagcgcggtgggaagctgaaaaaactgaatatcaagcaaccatgcaaagcccgatgtctgtccggagaggatgctttctaaaacaggaaacccgcaccaaaagagcagtctgtattccgaagtgcggcggaaaacggaaatagacacggaaatccaagcaaagcaaagatgatactcatttgttgcggaaaatgcatgggagcagtctttttccgaaacaggaagtgtgacgggaaagctaaaatagatgcgggaatccaagtaaagcaaagccgatgcccgtttgtctcgaaaattgcgtgggagcggtctgttttctgaaacagaaagcgcggcgggagctgaaaaaaccgaatatcaagcaaccatgcagagcacgatgtctgtccggagaggattttgttttttgaagtaggaaacccgcgccaaaaattgaagtagaacgggatattgcgtgggcttgatcttctgaaacgcgggaaagtacgagaaatttgaaatgaggtggaaattcaaaaaagcaaagttgctccccgtttgagaattgtgcggagatggtccgttgtttgaagtcgaaaatcatggcaggcagcggaacataaatgaactttttaagaaaaatcggaaaggctccttttcactaacatttcctgtgttaaaatgtaaaaaaagtacgttcaaggggagctttttcaatggtgtttcaaaaaggggaaaagttagaagaagatttgtactccaatagcggcgtcctgttgctgcggaaagggacgtttcttacagaaaggctcgctgccattttaaataaatatgaagtcctgcgcgatccggaattggacggcaggcgcattgccaccgaagtgcccgggatcttccatgacttattatatgagagtatttaccatgaaatggaagaactccagcgcatcattcaagtgaaaacaaccctttgtgatgcagaagtggagagtatggaaaaaatttttcgcaagctttacaaagaagtgtttacgacccggacgtctattttggaactaatggagcatttctccgctgacgaatatttgttcaaacactgtatccatgtcgggctgatcgctgccaatattgggaaaattttgaagctggatcctgaaaagcaaagcctgctggcgcaaatggggcttttccacgatattggcaagttcaccattgacccgcaaattctcaataaaccgggaagactaacagatgaagagtttgccttgatcaagaagcatccggaagcgggttaccggctgcttgagaaaacatcgctcgacccgatgattttaaaagggaccctaatgcaccatgaacggctggacggctcaggctatccggatggcaggaaaaccattccttttcttgtcagaattttatcggtggcggatacgtttgacgccatttgttccaaccgcgcataccgcaggaggcagccggtgttttttgcaattgacgaattaatggcggacgccgatgctggccggctcgatcgggaaattgtcctcccgtttgccaactttctgatggaaaattaccggaaacagccgattacactgcgtaacggggtgaaagggagcattatccgtatccatccgcttcatccaaaccagcctgttcttaaagtcgaaggttacccggttttaaacctgatggaacaaaaactgaccttgtttcaaatcgccaatccttattaatcggggattcttatgtaccccatgtaaaaaagacaaagcgtgtctttttggagccggaaaggtgaaccggagagtacggtccggtccgccccggtagttcaacaaaacattcccggaaagagcgaagggtttggcaaagcgcggaagcctctgtcacaataacgcgattactacattcattccaaagcaagtcgggcattgacttgtcctgcccggttttggtatagtatttctattcaaatagcgacgatgaaggatcaatagtagccggaacttttccttttaaagcgagccgggggcggtggaagcccggcaaggaacccggtgaaacggcagtccggagtttttttcatggaaagtgggtgcgaaaatttcgcatcaactggggtggaaccgcgggaattcaagctctcgtccccaggctgttgcctggagccgggagctttttatatggaaacattcccgtccccaggggaaaccatttcaatgaaaaaaggagagatgacaatgagcgtcacgatggatcaaatcgtctcgcacgcgaaacaccgcgggtttattttcccgggttcggaaatttacggagggcttgccaacacttgggattatggcccgctcggcgtcgaattcaaaaacaacgttaaaaaagcctggtggaaaaaattcatccaggagtcgccgtacaatgtcggccttgatgctgccattctgatgaacccgcgcacatgggaagcaagcggccacctcggcaattttaatgacccgatgatcgactgcaaacactgtaaagctcggcaccgtgccgacaaactgatcgaaaatgccctgcatgaaaaagggatcgacatgattgttgacggcctgccgtttgaaaaaatggaagcgctgattaaagagcatgacatcgcctgcccggattgcggcagcaaagactggaccggcattcgccagtttaatctgatgttcaaaacgtaccagggtgtaaccgaagacagcacgaatgaattgtatttgcgcccggaaaccgcacaaggcatttttgtcaattttaaaaatgtacaacggacaatgcgtaaaaaattgccgttcgggattgcccaaatcggcaaaagtttccggaacgaaatcaccccggggaacttcattttccgcacgcgcgaatttgaacagatggaacttgaatttttctgcaggccgggcgaagagctgaaatggtttgactactggaaacagtatgcgcgcgagtttttactgaatctcggtatgagggaagaaaacttgcggctgcgcgaccatgaaaaagaagaactatcccactactcgaacgcgaccaccgactttgaatacaacttcccgttcggctggggcgaactgtggggcatagcctcccgtaccgattacgacctgaaacgccatatggaatattccggcgaggatttcacttatcttgaccaggaaacgaatgaacgctttgttccgtactgtattgagccgtcgcttggggcggaccgtgtagcactggcatttctgattgactcttatgcagaagaggaacttgaagacggcacaagccgtacggtcatgcacctgcacccggcccttgcgccatacaaagccgcggttttgccgctgtcgaaaaaattatcagctgaagcacgcgacattttttcggatttgtcgaaaacgtttatggttgattttgacgaaaccgggtcgatcggcaagcgctaccgccgccaggacgaaattggcacaccgttttgcatcacatacgacttcgattcgcgcgacgaccatatggtgaccgtccgcgaccgtgacacaatggagcaaacccgtgtgccaatcacggaacttaaagcctttttggaagaaaaaattaagttttaaaaaaagcccgcaacttgcgggtttttttctttgttggtgcgccggacagccataagcaaatctatcctgatcgtaatggattttggcgtttggaacgcctaattagaccataattagacatttttaacgggttttacgcttggatttgtccaattagaacgcctaactagacattttcaacgggttttcgcctaatttgtctaattggatgcggcgtgttttgtccttttgacaggttcaaagggacatttcattcccggatgcggcatgttttgtccttttgacaggttcaaaaggacatttcgggcccggatgcagctcgttttgtctttttgacggcttcaaaaggacatttcgggcccggatgcaactccttttgtccttttgacaggttcaaaaggacatttcgttacctgatgcagctcgttttgtctttttgacggcttcaaaaggacattttgggcccggatgcaattccttttgtccttttgacaggttcaaaaggacatttcattcccggatgcggcacgttttgtccttttgacaggttcaaaaggacatttcgggcccgaatggagctcctaattagacaattccaccgggttcgcacctcttttggtcttatgtttccaattgatccgcctgccccaagaggtcatcttttcatccccaggttttaccttcctaactctgtttatctctttactccggatttgccgaaaaaccttgctttttgcatgctttaggcacattcggatattctacaaaagaagcatgattgaaaattaggtaccgtgagcaaagacagtttgcccggggatatggcgggtaaagatggacataccgaaacgcaattgcgaaatagtctttacaaaccatggtaacgggagtaagataggatgtcgtatgaaaaatttgtgtttcataactgaaccgcttaatccggaaacggaacgggggaaccaggttggcggccgcgcgccgctttggggtgaagcctttttttaaaaaggcagggccactcttatgcccgaacccgacagctaaccccgtcagcgttataagagaggatgtgaaactgtgatcgggcaatagaccacagggaagataaattctctttgtggtttttcttatttttggggaagcatttttgaaacactgcagataaaaggagaccattcaaatgttcaccatgataaaacgattgttaattgggagaccgctgcgttcaaatgaactcgaaggccagaagctaaccaagttaaaagcactggccattctgtcatccgacgcactttcatctgttgcgtacgggcctgaacaggtgctgattgtacttgccacagtggggacgctggcattttggtattctattccaattacagtcggcattttaattttattggctgcacttattttatcttatcgccaggtcatttactcttatccgcaaggcggtggggcataccttgtctcgaaagaaaatctcggcgtcacccctggccttcttgcgggcggatctttgctggtggactacattttaacggtggccgtttccgtctcagccggaacagatgccattacttccgcgtttcagagcttgcatccgtacagtgtgcagattgcggtttttctcgttctgatcattacgattctgaatttgcgcgggctgacggaatcggccaatgtgctcgcttacccggtttatctgttcgtattttcattgtttgtcatcattgttgtcggtttattcaaaacagtaacggggcaaatcccgcaaaacctgcatccgcatatcggtacgccggtcgccggcatttcactgtttcttttgttaaaagctttctcatccggctgttcggcattgacaggggtcgaagccatttccaacgcgatcccgaacttccgcgacccggcaccgagaaacgcagcccgcacgcttgccatgatgggtatcattctggcatcgcttttagcgggcatcagttttctcgcatactggctcggcattgcgccgaaagaaacagaaaccgttgtatcgcaaatggcacaccgggcacttggcaacggtgttttgtactatttcgtccaggcaactacggctttaattctcgtgcttgctgcgaacaccggattctctgcgttcccgcagctcgcttttaacttggcgagggacaaatttatgccgcgcatgttcacgatccgcggtgaccggcttggttactcaaacggaattatttttctcggcgctgcttccatgattttaattgtcgcattccagggcaataccgagcgcctcattccgttgtacgcagtcggcgtgttcattccgtttacccttgcgcaatgcggcatgattgtgaaatgggtcactcaaagaccgagaggctgggccggcaaaatgtcggtcaactttgtcggtgccattattacatttagcgtccttgcgattttattcattacgaaattcacgcaagtatggccggttttgattttcctgccgatcgtcatgtttattttccggaaagtgaaccggcattacgaggcggtcggcgagcagttgcggattaaaggggtgtttcaggaagaaatccactccaatgtgatcattgtcccggtggccggcattacaacggtcgtggaacggacgattaattatgcaaaatcgctctcggatcaggtcatagccgtttatgtcgcttttgaccatgaagacgagaagagaatggaagaaaaatggaaagagtgggactgtggtgtccgccttgtcaccctgcactcgtcttaccggagcattgtccagccgcttgccaaatttttggaaattatccagcggaaagcaaaagaaaacaagtaccaggtcatggtactcattccacagttcattccgaaaaaacgctggcaaaacattttgcacaaccagtccgcgctcctcatccggatgcgccttctctgggaaaaagacgttgtcgttgcaacaatgccctaccattttaaaaaataacaaatctggatgcaccattttcactgcaatacggctgtatcaaaaaaggctgcccgctacgcgttcggcagccttttttgatgagcagaacaaattaccgtagacgcttcgttcaacatcaaacgcggcaaaagccaaaataaaaaagccgcgcaacgccgcgcagccaaaatcttatcggttccaaatcaaaagaagcaaaacaatcgccaaaaggatgcggtatatcgcaaacgggaccagctttaccttgttgatcagtgcgaggaaaaacttgatcgcgattaaggcgaaaataaacgcgctgatgaatccggtaataaagaacggaatcgtctcaggtgttacggcaccccaatgctttacaagcgaaagaaagctcgcgccaaacatgatcggcacggccataataaacgtaaagtccgctgccgcacggtgactcatgccaagcaagacgccgcctgaaatcgtggagccggaacgtgaaaaacccggccacagggcaagacattgaaaaagcccaaccacaaacgcctgtctatatgtaatctggtcgaccgtctccgtcttcggccgacgtgggcgcgtgagatccgctacaatcatcaaaatggctccaaccaccagggcaacaagtaccgtattcaccgaaaacagatgggcatcaatatagtcttcaaacaaaaagccgagcacagccgccggaacgagcccggtaatcacatgcgtcaatctcagccgttcaccgtacatctgctctctcgtaatattttttttcaggccaagcaaatttaaaaatctgtcccaaaaaaccacaaccatcgccataatggacccaagctggatcaccactttaaatacatttgccgcttcagtgccataaagatgattcgatttcaaaatcaagtcatccacaataatcatatggcccgtcgaagaaaccggggcaaactctgtcagcccctccacaaggccgagaatggcggccacaaacaaattccacaaatgcaaaaacgtcacctccagactacattattctaccatggacaccggccaaaacgaataaattttttacgaaccccgccatgcttaatcagaaaataaattgaattcaagtgattataagttgaaaatgtttacaatacactataagataaagataaagaagcccggggaggggaaaaaatgcctggaaatctcagctttggcgaagttctcattattcttgttgttgccctattaattttcggcccgtcgaaactcccgcagcttggaagggcagccggccaaacattgcgcgaattcaaaaaaggcgtgcgcgacgccattgacgaagaagaaaagccgcaagtgaaaaaaagtaaatcataaccataggccgctgtaaaacgcagcggcccattttttgcatgcaccccgccattttccgaacgcttttcatggtaaaacaccgaaagacgaccgccctgacaccttcacgagccgtcgtgtaaaaatacgaccagcatactgccacttttcatctcattgccagtgctgcaaaaaatgtctgatcctttttgcgaaaaacgcagcagccagttttttattcgcgctgccgtcatccgaacatttttcacggtaaaacaccgaaagacgaccgccctgacaccttcacgggccgaaaatgcagccgtaacgccctgtccccggggacggattcaattttcctgatcgtgctatataagttgaaccaaacattagttgccagaagcaatgtctatcctgatcgtaattgattttgacgcgaaaaacttaagttctttttatatagcagcgggaactgcgggctccccgtgggctgattcatctgtatggtttatttccttttatggcaggaaaaaattttacacatccctcgccgactaaattacttgaaccggctataaatgtgttaagataagggtaaacagaaaaatggttcctttgaatccggagggggcaataacaatacgatggaagaccggctgttttcattatttcaaaaacggggggtcagaagggtccttatctttgtgctgatcgcagtgattctttattttctgcgcagcatgatggatctgatgctgctcacctttattttttcctatcttgttaaccggctgcagaaaattgtaaccagatggttcccgatcaaacgcagactggctgttttgatcgtgtacattttaattctcggtggcctcacactcggcgtgatcaaatattttccgatcctggtcaatgaaattacccagcttgttatgcaaatttccgatttctacacgaaacctcagcacaatgaagtattgaattatattgtgaaaaacatccaggaaaagaaaatcgtcgactacgcacaaaaaggcgtttccatcctgttcgattattttacaagcatcagcaaagtcagcatccaggtcttcatggccattatcctgagtttgtttttcctgcttgaaaaagagcggatcatccgttttacaaaacagtttaaaaagagcaaacttgcagcgttttacgatgaaatcgagtatttcggtgtcaaatttgtagggacattcgggaaagtgatcgaggcccagttcatcatcgcagttgtgaattccgttcttactacgatcggcctctggattctcggctttccgcagttattcgggcttgccattctcgtttttgctctcggccttatcccggtcgccggcgttttcatctcgctcattccgctctgtatcatcgcttacagcatcggtggcggaatgaaagtactgtatgtcctcattttgattgtcatcgtgcatgccgtggaagcctatgtgctgaatccgcagctgatgtcctcaaaaacgaatatgcctgttttttacacttttctcattttaattttttgtgagcattttttcggtctgtgggggctcattcttggtattcccattgtgatgttcttccttgatgttcttgaagttaccggccaaagtacggagccaaagaaaaaaacataatgtgtacaatacaccagccgttccaaaagaggtaagcattttggaacggcttttttcacagatgaattccttgctaaacgctttctgacattgaattctcaccagactttagtcctagagaccgcttgggtttttaatattttaaaaaaataactcttcccggaaaatccatcttaaaaaacagaaaaataccttcaataaaaatattgatgttatctgaatagattgatatactctaaaatagggagtaatggaaggtttctaaatactggaagcgcacaccaaaaagatgagcagccgggaggtgatgatgtgatttcattccgtcatgtcaacaaatactatggtgattttcacgttttaaaagatattaaccttgaagtaaaagaaggggaagtcgtcgttgtgatcgggccttccggatcagggaagagtacaatgctccgctgcatcaaccgtctggaagacatcacggacggcgagctcttcgtccgcaatatgaaagtcaatgacaaaaaaaccgatatcaacgatcttcgcaaaaacatcggcatggtcttccagcacttcaatttgtatccgcatagaactgtcttgcaaaatatcacgctggcgccgatcaaagtgctgggccaaagtaaggaagaagcggaaaaaaaggcgatgcactacttggaaagggtgggcattccggataaagcaaacgcctacccgtcacagttatcaggcggccagcagcaacgtgtcgcaattgccagggggctggcaatggagccggacattatgctgtttgacgaaccgacatctgccttggatcccgagatgatcggagaagtgctcgacgttatgaaagcactcgcaaaagacggtatgacgatggtagttgtcacgcacgaaatgggctttgcccgcgaagtggcggaccgcgtccttttcatggaccaggggagaatcattgaggacaatacgccggaagactttttcaaaaacccgcgtgaagaacgcgcccgcacctttttaaaccgtgtgctgaaccattaaccacaggccatggtacatacacttgcaaaacatgtgtatccgggcaggatgctaaaaatggaagcaaacgaccgcggctattgggtacacgcatgtcggccgtcgatcgccggaaagccggctacgaatggtggccaaacatcctgcatcacgcccgggcaggatgctaaaaatcgggtgcaaaccatacgcggttatcaggtccatacatggcggcatcaatcgccggaaagccggttacgatggcggccaaacaccctgcatcacgcccgggcaggatgccagaaatcggaagcaaacgatccgcggctatcgggtgcacgcatggcggcatcactgccggaaagccgttttctcgtggcggccaaataacctgtaccacgcgggtcaggatgccaaaaaatgaaagcaaacgatccgcggctatcgggtacacgtacggtggccgtcaatcgccgggaaagccggttccagtcgcagtcataaaccatttgcatctgcatatacattcatatccggggatggtgcgcaatcatggccataagccaaggaatggtaggtgccggcccgcgggaataccgtgctactcaaagcagtaccagcataaaacatttatcattggggacttccgcaaagcgcttgctttcgcggtgaccataaataaaaaagggggattcaaatgggaaaggtcaaaaaatggttagcagcaggattggttttcattttggcagcagcactggttgcaggctgcggcaaatcaaaatcgacaggcggatccggttctgcaagcgatgatccgatcaaaaaaatcgaagacagagggaaattggtcgttggagtcaaatatgatacatatctatttggctacaaagaccctaaaaccggaaatgtggaaggctttgatgtagacattgccaaagcgatttccaagaaaattttcggtgacaaagtcaaagtcgaactgaaagaagtcacatcgaaaacccggattccaatgctgcaaaacggcgatgttgacatggttgtcgctaccatgacgatttcgccggatcgtaaaaaagtggtcgacttctcggatgtttattttgacgccggccagtcgctccttgtgaaaaaaggaagcaagattaagagcgtcaaagacttgacgaaaggcacaaaagtcttgacggtaaaaggtgcgacatctggtgacaacgtcagaaaagccgctccggatacaactgtgctcgagtatgaaaactatcaggaagcattcacggctttgaaatccggaaaaggggatgcgctgacaaccgacaactcgatcctttacggcatggctgcccaggatccgaattaccaggtggtcggcggcactttcacgaaagagccgtatggcatcgcgatgaaaaaaggcaatacgaaactcgtaaaagccgtcaacaaagctttgaaagaactgaaagacagcggggaatacgacaaaatcaaaaacaaatggatcaaagaataaggataaggggtgggcaaaatcgcccatccctttctcctgattaaaccgcaaaggagtgaaacagcgtgctcgatttttccatcctcaccgacaatatcgacttatacatgaaaggttttgtcaatacgattaaaatcagcatcatcggccttgccgccagcttcattctcggcaacatcattgccgtgttcaggctggcccccgtgaaactgctgaattttatcggcgcagtctacgtcgaagtcatccgcaatattccgttaatcctgaccgggttctttttctataacgggctcagctattttcatattaatttaagcggctttatcgcgggtaccattgcgctctccatttacactgccgcttttattgcagaagccgtgcgtgccggcattcaatcggtggacaagggccagcttgaagccgcacggtcaaccggtttgacgtatacccaggcgatgcgttacgtcgtcctcccgcaggcaatcaaaatcgtcattccgccgatcggcaaccaattcctgaacctggtcaaaaactcttcgatcctcggcgtttttgcgggactcgacctcatgtattacgccgatctcattcatgaaaaaacatgggtcacttttgatacgtatattttcgtcggcatgttttatctcattctgacgatcccgctcagcctgcttgtcaactatcttgaacgccggctggccagaagcagttgaatcatatttaaaggagggaaatgtgatggattttgccggagcttattcaagcggaaacctggcttatttgctaaagggttttgcggtaacattggaagtggctgttgttgcaatcgtgctgagctttctcatcggctgtatcctcggcatcttgcgttacgccaaaatcccggttttatcgccaatcgtggcacttgttgtggaaatcacccggaacctgccgctgattttgattattttctttacatattttgccttgccggaagttggcgtgaaaatgagcgtcacagctgcagccatttcggcgctgacggtgttcgaatccgcgatgattgctgaaattgtgcgcggcggcctgaacgccatcccgaaaggccagatcgaagctgcccgttcatccggcttgaaatatacccaaaccttgtggtacatcattctgccgcaagctttgaaaaaaatgatcccgccgcttgtgagccagttcatctcacttttaaaagatacgtcgcttgcgatcatcattgcgctgccggaactgttacacaatgcaaaagggatttacaacggggaaggcggatcaaaatacatcatcccgattctgctcatggcagctttcatgtattttgttgtcaactacttgctttcgattctcgcgcgccggctcgaaaagcgcctcgacccggaccgttccgctgccaaacagcttgtgaacacaacagaaaatttgctctaggggaacctgtcctgaggttccttttttttgcgcagcttttctcatgatagagatgtttgcgattgctgattttcattcgcaaagttgcaaaataaatcaaatccccattgcttttttgtgctaactgttatacaatatatataacaaataacccaaataaaagagatgatgttcatgctcatgaaaatcgaccttgaatcggatgtccctatttaccaacagctgcataacagcatcattgaaggcattgcgtcaaaagagctggcaccgggcgattcacttccatcggtaagggcgatggcatccgacctcggtgtcaacatgcacacggtcaataaagcctaccaaatcttgaagcaggaaggctttatccagatccaccggcaaaaaggggttgtcatccagcctgaacagatgcccccggccgatgaaccgtatcttgaaagccttacgggaaaactgcgcccgctcatcagtgaagcgatctgtcgcggcctggacgaaaagcaatttttaaaaatatgtgaaaagctatacaacgatattcaaaaggtgggagaacaatggaaaccataatggtattgatctttttcggtctggttgccgtcatgatggcagtaacaccgtacattacaagaaaaacggaaagttttggggtcaccatcccagaggcagcctacctggatcctgaactgaaaaaactgaggaaacaatacgccgcagtcattattgtcttcagcatccttctggcagccgccctgttcatagctgtaagcacaagccagttgcttcaaactggtttcgctctcgcagtccttgttgacattgccggtaattttctcatctatctttattttcaccgaaaaatgaaggcaatcaagaagacgcggaactgggcaactgggaaaaagcaggcgatcatcgtcgacccgaaattccggagccagaaactcattttttccaacgcatggtttctgatccatgcaagcgtgacagcagccactttcctgatgacatggttgtgctacggacggattccggaccggatcgccatgcattatgattttaacggtacaccgacagactgggtggaaaaatcgtaccggaccgtgtttgaactgccaactgtccagctgttcttgcttatcctgttcatttggctgaatacgatgattgcaagaagtaaacagcagctcaatgccgaaagaccggaagcctccctcgagcaaaatgtccgtttccggcgcagatggtcagcatttatgatcattacaggcttgcttatgattttactattttttgccattcagctttcctttattgtgccggtcccgattgcctggttgtcgtacggaggcatgggcgcggtcctgttgattgtggccggggcggttttgctctcggttatcaccgggcagggcggcagccgcatccgcgtaggcaatggtgccgttcagggccgcttccagtatgatgatgatgcgtattggaaactcggcgttttttacttcaatcgcaacgatccttccttatgggtggaaaaaaggttcgggagcggctggacccttaactttgcgcacccggcaggctggattatcctcgggctcattattctgattccgcttttgcttggtgttttcttttcttaaaaaacaagggggctgctccaaagaatggaagcaaccccttttattattcactttcaagatcaacccatttgtctgcccaattttgcacttcatcaaggaccggcttgatcgcctcgcctttttctgtcaaccggtattcgatccggacagggctttccgggtacacttcccgtacaagaatgtcctggtcttccagctccttcagccgctccgaaagcaccttttggctgatatgcgggataagctccgccatttcgttaaaccgcatcggcccattagaaaggacacggataatcacgccaacccagcgttttcccaatagctgaaacgccttttcgaaacgcggacataaactttggtttcccatttttgtaacgcacctttcttatcaaccctgcattccggggctatatcaacaaaaccctttttaaccattatacatgaattgtgaacttactaaaagtaactagctaacaatctctgtccaggggaactgctgtgcttcgctgaaaaagctggcaaacccgtgacagaaatggccctaaaaaatccccaaataaagacgaaaaaatgaaaatgagaggaaatgcacagtgaaacggtgctgcccccaaataaaaaagcgaaaaggaaaatgctccgatgcgtcctggccgggtaaagttcttccaatccattgaattttcatataaaataaagggagtaaagaaaggaaggtttttaaggtgaaaaaattacttttctatacagcagtaggctttgccggctaccaatacttcaaatcaaaagaaaaccgtgaaaaagcggcagatgccttgaacaagttttatggaaacgtggaaaaatggctctcaaattttcagcaatcaaatcgcggcggaaacaggcaatccggcacacaagcctaaaggcagacagtgattgggcgtagttaccattgcgattcagtcaggcgaatgcttgaaatgatctcccacctgctctttggccatgaggatgggagacttctttcataaatccgttaaaatggacttgatcattcacgccctcttctaatccccgttcacccacaactgtaaaattttccctgggccatcacaacagggaagtcgtgaaccttccaaatctcaaataaaatttacaggtgtaaaaaccatacggagacgggtgaagtatcatggccgaaagcggataaaataaatactgaatcttgaatgttccctggcaaaatacggcaaccgaaacaataagcctcatgtaaaaaactccccaaagcctggtgaatatataaaatgaacctaaatttttcgcgttaaaatcaattacgatggctacacatacagaagtaggaatgtttagttcaacttatgcagcagccgaaagcagaaaacacgtttcttaacttaatgcaaaacgggtgcgggaacacgctgggtccgggaaagaagctggttttaaatctggatggttccctgcaaagtgcctatcataaaattgacaactatcaagtcttaacctttttgacaaacccaccctcatgcccgaaaatggctgtaagaagagtgaactttatgcaaacaaaagcggtcgtttttattgacgccgtttaagagagggatacaaatgtcggtgacatcatacgtcgatcaatatggatatattgtgctgcttttggcacttttgctcgaaatgattgcagttccgcttccaggcgaagtgctgatgagctatgccggttatatggtgcaccaggggcagctcaactggatcttgagcattctcattgccgccaccggtacatctgtcggcatgacaacggcctattttatcgggcagcggctcggcggcccgtttttacataaatacggccattttatccatctcggcccgtcccagcttgaaaaaacatcgcgctggtttaataaatatgggaataaattgcttatcgtcgcgtattttataccaggtgtccgccacatcaccggctatttttccggaattacgaaactgccattccggtcatttgccacttttgcctattccggcgctttgatttggacaagcacgtttatttccctcgggaagctgcttggctcgcagtgggagcagttccacgaagcggtaaaaaaatatctcgtcataggcggtattgtaagcgccggcttaatcatcgcgtattatgtgttccgctatttccataagcagattttctgggcgatgatggcggtgctccggcgcgttttcatgattttccgcagccgggtgcgcgccgagtttgtgatcatcggcaccacgctggtgacattgtttttgattgtgttaatgatcacaatgattcaaaaccttttcagcgaagatttcagcgactttaacgaggtgacctctttaatcgtatcgcttttgttcaaacaccattgggcaggcgtcatgaaagggatgctggcgctcagctcgcggcaggcgctcattctcgtcatggtgttgacggttctttggatcatttggaaaggcaaagatcgcacgcacgaatttttgattatgctgcttgtcacaatcggcggggaactgtatcaaaatgtgctgcatgaagtgttccaccggatgtcggaaacggaaattccgacgttttcccactttgtcttctcatttccgagcgaccaggcgatgatgattctgatcatttacggctattttacatatctcgttgtccggcacgctgagatgttttgggtccatacgtttatggatgtacttcttttagctgttctgttgttcgcagctgtcagccatatttatttcggccttgaaatcccgagcaacattgcgggcggttacgtattcggcggcgtctggcttggcttaaatattttattgctggaaattttccgtatgatatgatggataagaaagcaaatgttggaggggaaacatgttctcagactttgtcacacaaattttaacagcactcgctgatctgggttacttcggtgttgcgatcgggcttgcgattgagattatcccgagcgagattgtccttgcctatgccggctatttaatttcccggggagagatcaattatttcggcgccattgcagcgggcacacttggcattttgattgcccaactgattttatactggatcggtgcatacggtgggcgcccgttcttgctaaagtacggcaaatatttgctgattcacgaaaggcatctcgatgtcgcggaagaatggttcaacaagtacggcgccggtgttatttttacgggccgattcatcccggtcatccgccaggccatttcgatcccggccggcattgccaaaatgtcgtatttcaagttcatttttttcacgctgcttgcgaccattccgtgggcggtgctgtttatctttctcggtgaacgtctcgcatcaaactgggcacaaattgatgacgtcgcggctccttatgtcaagccggtgaccattatcgcgatcgttatcattgtgctttatatcgcttactcgatgtaccgcaagaaaaaaaaagcctgaccctctatttagggggccgggctttttccatagatgagggaagaatggaaacagtgcggttcggatcccaagaacggctaactcccactaaatcaaagatacagaggggattagctgctataattgttcaaaatccttaaccaaaaaaaccgcctgcacaaagcagacggccaaaaaagggggttaacatggatgaaaaagcaagccggattttcatcttgcctgattacaagaaaaaggataacgccgaaagcttaaaacaatcttaacaggccgaaattttgaaaaagaggcatgtttatctgctatggccgaaaaaaaccgcctgcacaaagcagacggccaaaaaagggggttaacatggatgaaaaagcaagccggattttcatcttgcttgattacaagaaaaaggataacgccgaaagcttaaaacaaccttaacaggccgaaattccgaaaagaggcaggcttgcccactatgcccagaaaaaaaccgcctgcacaagggcggcctaaaaaagggggcatataaaaaagtaggttgtaagctctcttgcaaagaaaaggatacctgccgaaacttaaaaaatgcttaaaacctccgcgtctctggccataaaaaaacgcctgcacaaagcagacgaaccaacaaaagctcttacctgatgacaaacatcaatataccgctggaaaataaaaaacgccttaactttgcatgaaagttatgtgaaattccccacaaattatgatctcgacaaaaataacaaaatttcatcaaaattttcgtgacaaattgccgcttttagataataataatgaagacagactactaaaacgagggattctatggagtcaagagtagcgaaaaaaaagaaaaaacggtcaagagtccgctggcgcagagtgttccttatgctctttttactgctcatcgtcgccggcgcgggttacacagcctatcaatactacgctggcgttcatcagacagacccgaatgatgccttaaatatggacaatctggaatttaacggtaaaaaggatgcaaatggccgcaccaatattctccttcttggaattgatcggcgcgggcaagaagattcaagaaccgataccatcatgattgcccaatatgacccgaagaataaccaggtgaagctcatttcgattatgcgtgacatttatgccgaaattccggggtatagaaactataaaattaacacagcctactatcttggcaatctgaagaatcaaaaaaagggtgttgaattgctgcgtcaaacactcaaaaccaattttgacattgatgtgcaatattatgcacttgtcgatttccaaggttttgttaaaattgtcgataccctggcgcctcaaggcattgaaatgaacgtggaacataaaatgtcggaaaacatcggcttgacgctttatcctggaaaacagctgatgcatgggaaacaattgctcgcctacgcacgattcagacatgacgcgcaaggcgactttggccgggttgcccgccagcaaaaagtgcttaaagcgctccaatctgaagttttcagcgtgaacggtatcgccaaagcgccgaaactgcttggaaccattcagccgtatattgccaccaatatgagcaaaatgaacattcttgcgctcgccaaagacgccgtcggaggcaacctcaaggtaaaaacaatgaccgtaccggttgccggcacctataccaatgtcagctatccgggcgtcggcgccgcactcgaagtggacaaagaaaaaaatatagaagccatcaaacagtttttggatgaataacaggggccggttccggctcttttttttgttgcagacagaaagccgtaccgggagcaaattgtccttttggagggttcaaaaagacaaaagaaagccggactaggagcaaattgtctttttgaagggttcaaaaagacaaaagagagccgtaccgggagcaaattgtccttttggagagctctaaaagacaaaagaaagccggaccaggagcaaattgtccttttggagagctcaaaaagacaaaagaaagccggaccaagagcaaattgtctttttgaagggttcaaaaagaaaaaagagagccgtaccgggagcaaattgtctttttggagagctcaaaaagacaaaagaaagccggaccaagagcaaattgtccttttggagagctcaaaaagacaaaagaaagccggaccaggagcaaattgtctctttggagggttcaaaaagacaaaagaaagccggaccaagagcaaattgtccttttgaagggctcaaaaagacaaaagaaagccggaccaggagcaaattgtccttttgaagggttcaaaaagacaaaagaaaaccgtaccaggagccaattgtccttttggagggctcaaaaaggcaaaagaaagccaattagacaataggggtgaaaccgcatccaatatgaatttcaatttcccccttgtcatgtcacccgacaaagtgtaaagtataaataagtcaaaattttaagtacgttcaatcgaatagccttatcaagagaggcggagggacttggcccgatgaaacctcagcaaccagcccatacggcacggtgctaaatccaacaggtatacctgaaaagataaggagtcatgttatcatcttgcctccttttccgggaggcttttttcatattattcaaagggagtgtaaaatttggaccttctcgaaacgttaaaaaaccgcatccttgttgcggacggggcaatggggacactgctatatgcatacggcgccgacacatgctatgagtcattcaacctgacccatccggaagacatccacgcgatccaccgcgcctatatcgaagcaggtgcatcggtcatccagacaaacacatatagcgccaactatatcaagcttgcacagtatggcctggaagaaaaagtaaaagacatcaacaaagcggctgtccagatcgcaaaagaagcggcaaaccgcgatacattcatactcggcacagtcggcggcatccgcggccagcgcaaaaccgaagcaacacttgccgaaatcaagcgtacgttccgcgagcagatttttcacctcctgaacgaaggagttgatgccctgcttttggaaacgtattttgacgcggaagaactgtatacggtcgtagacattgcgaaaaaagaagcggatgtcccggtcatcgcccagttctcgcttatcgaaccgggcgtgctccaaaacggaaccccggtccgcgatgctttcaaggaacttgaaaaccgcggcgctgatgtgaccggcctaaactgccggctcggcccgcaccacatgatccaggcgttcgaagaaatcccgataccgaagcgtgcctttttgtccgcatacccgaatgcgagtcttttagattacgaggaaggccggttcacgttcacaaataacgccgattattttaaaacatgcgccgaaaaactggtcgaacagggtgtgcgcctgatcggcggctgctgcggcacgaccccagctcacatcaaagcaatcgcagacggggtgcaggggcttttgcctgtcacagaaaaaacggtccgcccaccgaaaattgaaatcgcagccgccccggcgcagcacgaaccaccgttgcatgaaatcgtaaaaaagcgccgctctgtcattgtcgaattggatacgccgaaaactctgaacacggcccgcttttttgaaggggcaaaagcgctgcacgacgccggcatcgatgccttgacaatggccgacaactcgcttgcaagcccgcgcatcagcaacacagcgattgcttcaattttaaaagagaaacatggcatccggccgcttgttcatattacatgccgtgatcgtaatttgatcgggctgcagtcgcacttaatgggccttgctgcgctcgggattgaccaggtgcttgccatcacgggggatccgacaaaaatcggcgacttcccgggagcgacgagcgtatacgatttgtcatccatggaactgatcgcaatgatcaagcaattcaatgatggcatttcccattccggcaaatcgcttcacaggaaaacgaatttttccgtcgcggctgcatttaacccgaacgtccgcaatcttgataaaacggtcgggaggttggagcgcaaaatccgccacggtgccgattattttatcacccagcctgtgttcagcacggaaaaaatcgagcaaatccatgaagcaacgaagcatttggacgcgccgatctatcttggcattatgccgcttaccagctaccggaacgcggtctttctgcacaatgaagtgccgggcatcaaactgacggatgaaattttggcggcgatggaaaaaacaaatggcgaccctgcgaaagcgcgtgaagaaagccttgcgatcagccgtaccctgatcgacgcggccctcggctatttcaacggcatttacttaattacgccgctcgaacgctacgaactgacggtggaatgcacgcgctatatccacgaaaaaacagcagtgcaaggcgcaggcattgtctgagactgcaacgaaaagagtacaggcggattcattaaagtgaaactttgatagcactgtccaattgcaagattaagaaaagagctcaagaaggcaaaacgaaaccttggccggcttcagccccggcgagatgcatgcactttaaactcaatcaaaagtggcaccggcgccgccagcatcggaacgcgacccagccaggtaccaaatgttaccgtacgtcgcaatctcaatatcaaacgtacaaccaaagggggaatttttcatggggcaaacgttatttgaacagcagcttgcaaaccgcattctcatccttgacggggcgatggggacgatgatccagcagcaacaccttaccgcggcagattttggcggcgaagcatacgaaggctgcaatgaacacttgaatctcacagcgcccgatgtcatccgctcgattcatgaagcatatctcgaagcgggggctgacatcatcgaaacgaacacatttggcgcaacgtccatcgtccttaacgagtacggcctcgggcatctcgctgaaaaaatcaacatcgaagccgcgcgcatcgccaagcaggctgccaaaaaattttccacacccgagcggccgcggtttgtcgccggttcgatgggcccgacaacaaagacgctctctgtcacgggcggcactacttttgacgcgctcaaaaccgcttaccaggaacaggcttgcgggctcataaaaggcggcgccgacgtgcttctcctcgaaacatcgctggacttgctgaacgtcaaagccgcttttcttggcattacggatgcattcaacgaaaccggaaaaaaactgccgcttctcatctccggcaccatcgaaccgatgggcacaacgcttgctggtcagaacattgaagcattttacatttccgtcgagcatatgcagccggccgcagtcgggcttaactgcgcgaccggcccggagttcatggccgactcgatccgcacactcgcggggctcgccaaaacggcagtgagctgctacccgaacgccgggcttcccgacgaagaagggcattaccacgaaacaccggaatcgctcgctgtcaaaatgaaaggcttcgccgaaaaaggctggctcaacatcgcaggcggctgctgcggcacaacacctgcccatatcaaagcactgaatgaagcacttgccgggctcccgccgcgccagcctgcaaaacaagaacaccacgccgtctccggcatcgaaccatttatttacgatgacccgtccacccgtccgatttttgtcggcgaacgcacaaacgtcatcggctcgcgcaagttccggcgcctgatcgcggaaggcaaatgggaagaagcaagtgaaattgcccgcacacaggttaaaaatggcgcacagatcatcgacatctgcctcgccgatccggaccgcgatgaaatcagcgatatggaaaattttatttcgatcgccgtgaaaaaagtgaaagtgccgtttatgatcgattccacagacgaaaacgtaatcgaaaaagcttttacatactgccagggaaaaagcattgtcaattccattaaccttgaaaacggtacggaacggtttgaaaaagtcgtgccgctcctcaaaaaatacgggggtgccgttgtcgtcggcacgatcgatgaagaggggatggctgtcactgccgaacggaaacttgagattgcgcgccgctcttatgatctgctcgtcgatacgtacgggctcaacccgcgtgatcttatttttgacacgctcgtgttcccggccggcaccggcgacaagcagtattttggcgcagcaaaagaaacggtcgaaggcatccgcttcatcaaagaagcgatgccggaatgccagacaatcctcggcgtcagcaatgtttcattcgggctgccgccagccgggcgtgaagtgctaaactcagtgtttctctaccattgtacgaaagccgggctggattacgccatcgtgaacacagaaaaactcgaacgctttgcgtccatcccggaagaaaacgtgaaaatggccgaaaaactgttgtttgaaacgagtgacgaagcccttgccgcgttcaccgaatattaccgcggcaaggtgcaggagaaaaaagcgccaaagagcacgatgacgcttgccgaacggcttgcgaattacgttgtcgaagggacgaaagaaggcctcatcccggatcttgaacaggctttgaaggaatacccggatccgctcgccattatcaacggcccgcttatggacgggatggcggaagtcggccgcctgtttaacgacaaccagctcatcgtcgcagaagtcttgcagagtgcggaagtgatgaaagcatccgtcgcattccttgagccttttatggaaaaaaatgaaacaagcacaaaagggaaagtgctgctcgcaaccgtgaaaggcgacgtccatgatatcggcaaaaatctggtcgacatcattttgtcaaataatggctataaagtggtcgaccttggcatcaaagtggcgccggctgatcttatccacgccgtccgtaaagagaaaccggatgtaatcgggctatccggcctccttgtcaaatccgcccagcaaatggtcgtcactgcccaggatttgcgggaagcgggcatccgtcagccgatactggtcggcggtgcagccctgtcgcggaaattcacggtaaataaaatcgctccgcaatatgaagggcttgtgctgtatgcaaaagacgcaatggagggcctcacgcttgcgaacaaattgcaggatgaatcggaacgaagctcgctcgaaacggaacttgccaaccagcgcagcggcgggacaagggtggcggccgtgaatgccggcggagcaccggttgcgactttaccgcgccgttcttcggtatccccggatgcgctcgtttaccagccggccgatttgaagcggcatgtgctgcgcaattatccgcttgcccatatcgagccctacgtgaacatgcaaatgctcctcggccaccatttaggattgaaaggccgcgtcgaaaagctgcttgcggagggagacgaacgcgccctcaagttgaaacagcaggtggatgaactgcgcgaatgggtgatgaaagaaaaattgcttcagccatccgctgtataccagtttttccctgcccaatcggatggtaatgatttgattctttacgaaccggctggagaacctggtacattagatccgaaatctttatccattttagagcgattcacgttcccgcgccaggcaaagccgccgtatttgtgccttgccgattatgtccggagcgtggacagcggggtcgtggattatgtctgcatgttcgcggtcgtcgccggcaaaaacatccgccatcatgcacgctatttgaaagaagcaggcgaatatttcaaaagtcatgccctccaggcgcttgcactcgaaacggcagaaggcttcgccgagcgactgcacgaactgttgcgcagccaatggggcttcccggacccggctgatttcacaatgcagcaacgctttgccgccaaataccaaggccagcgctactctttcggctacccggcctgcccgaacctcgaagaccagtccaaactgtttaaattgctgcaaccgcaaaaaatcggcctccacttgaccgaaggctacatgatggaacccgaagccgccgtcaccgcgcttgtattctcccatcctgaggcaagatattttgcggtataactcccgaagcgggccctggcccgcttcggttttttaaaccatttacgactttttcagagtccagtgccatgttgctttttacaaaaaaccaaatgattcgacaaaatctgcgctaacccgatttttctgttccgccctcaatgttccacgggaaacattccactgaaaactgtgcatgttgaacaggattttttgaacaaattccacttgccagcaagcccttcttcgatatgatagaagaatagacgtacgaacatgcttgacccgctttctttctatataaaataacgccatgctttcacctaccacgttccctgtggcattgaacgtctacgctaaatcaacgccggctgaataaaacctgtacatctcaaattcggccagtgctgtcatcatccttgcataacttaacattcccaatggctgcgaatattgacgtttttggtggcatgacaagatgacaagatacgattcatctcgacaaaaccagcaatatttccacggaaatacccatataaaaaagcccgaataccgaaatccgggctttacatccatctatctaaaaatgtgcggcgactgcggctaattttcattcttccactcatgccgtatcctttacggcatgagtggaaaatccgcattgaaccgtttcatcctgttctgatattagcctatggaagtccaaaagctccattgccttccagcatcttaccaagagcaaatggcttacttacgggagagacggtcttttgcatcaccgacagagtcttgggcctcgcctttcaatttgtccattttgccttcagcttgtttttccgcatcgccggtgatttcaccccacgtatcttttgcttcgcctttcaatttgttcccttttcctttgagcttgtccttcatggagtcttgatccattttcattcctcccattcatattgttcatctttcctattccctgatcacaggccgataaacgaaaaatgcaaaagaaataaatggacaggctagttatccgaccggcgcagatcatttgcgcaaaatttgacctatcacgtccaaaagcaaaaaaataaagggccaaaaccaaatcaaataggggcaccgccacaaccaaaaatacacctattacaacaggagaaagagatagagttcaatataaaaagattgcaacaaggcgatatccatttgcaaaaagcaggcaacagagctgtgatattttatgggacgtgaataatcggtgggtaaagggaacgcatgcgcatcatctccgtctcgctccaaaattggaatgaggaaacgcatgcgtatataggttggatggtgttgcagagtggatgtgtgttcggcgtaacgcccaatttcaacgattgcacgcccgttctcaaagcacctgaaaacagcccctagatcattttcttccatggtatgtatttgccgaggccatggtaatagctggcacaaataatcgtgcggctgaattgtttctgaaatgtatgcacggagcagttcagtttcagctgctgctgattggaaaaagtaacataaaggccgtccgccgtggcatcaaagtctattatgtttgccaggaaaatgaactggcagtcatacgatctcggggattttgtcggtgttgcaatcaaaccatcccccaccacaatcggtgccttattaaagttaaaaatttgttttgttcccttgagaacgccttcaaaatcgcacatccggtaatggatgcaagcgtcccgtaataattcaagcttgctcttccgtgagcgaaaaacgccgtcctgatcataaatgactgtttgatattccggatcaaatgcggtatccagcgccatcgtttctttcctgattaggtagtcaattttttctgtcacaaaaaataccccctcatgttaatttgtgctttccctcccgcttcactttcaggggcagaattgccaggggtgccatgtcttgctgccatcaaagtatccttccccaaaagaagagggatatcattgatttttatagtcctattatactataaatttctaaaaaataaagcatgaatttacaattttgttattatttttaatccatgtaaatcttggccaaaatttcacgttttcccttaaaaaatatcaaattttcccgcggaaaacaggatgttttggaaacgaaaaaatgacgatcgccggttcgccctcttcctttgaacctgttattttacaatcaacccgggaattcaaggaaagcgcgctttccaaaaggggaagcaaagtggaaaattttgaagaaatgctcaggcaataccggccgatgatttttcatatgatccgcaaactccgcatttacaaaaacatcgatgagttcgagcagatcggtatgattgcgctgtgggaagcgtatcagaacaggcaggacgacaaagggtcattcacgagctatgcgtacaacacgatccgtgggaaaatgctgtccgaactcacgaaaaggcggagggaggaaaaaatgttcgcatttccgaaagaggagttttggaatgtgaaagtggacgagtcgctccgtcccccgcttgaacttgaaacattgctgtcatattgcgaaggtcttacggaaaaagagaaaaaatgggtagtcgctgctttttatgaacaattgaaacaaggcgaaatcgcatttcgcgaaggcaagtccgtcgaggcggtaaaaaaatggcggagacaagccctcgagaaaatcagaaagagtatggagcaaaaagagaggaagcactgactgcttcctcactctgcgatgaaaaacttgcgcaagtagtcataccatgcttttgtgcctttgttgcttggggcggtttgttcgccattttgaaaggtgacatacgatttgaatgcgtcactgtccgggtctggccagtttttccaatgatccaggtatgtgtaaccttctttttttgcgtacgacgctagctctttcacctgcgccggataattcgctgccttatagagcgggtatgaaggctgaatcatcagcacggcatcatcccaggcagcagcggccgttttgatatcatcaagctgattgtccattgccacagccccgttgttgattaaaataaacggctcaaacaaaatgagatccggtttgaaatgggcgacgtctttatacttgccttcacggataaactcatcggaatttaaatgataggaaaaaagggaaaccgacacatggctgccgtacgtatcattcaacgcctgcttcaactgtggcccccagccatgcgtattcgcacccatcgcgtccgaaccgacaatcgcaattttgtaggctcgcttcttggaaagtgcgttttcaaaatccgcgcgggcttttttcggccagtttttcgtgtaagccactagagaagtctccggctggcccgttttgtttacgtcgcgctttttccccgtggtcggttctgcctttgtcttttccgcttttactgctacagaatccggcttgaaccggcttggatccgttttatacccccagtacagatgcccaactaccaatacggcaatgacgacaacagccgacaaaatcgccgtgaatattttcatacatcatacctccgctcatcatcacttatgaaacgcccgtgcaaacctataaaaaattatgacaaaaaaagacaaattacacaaccaaaattgaaagaaaatccgccaaaggtaaatacaggaagattatctaaccggtttctttctgcaaaatattgtggtttaatacaaagtgtatcaaattgtttaaatttatttcagtttcccgcaaatttcgggatgatctatgatataatgtatgatagttttctatctatttcgcatttgtgctgcaaattttaggggaggaacttatggaagacacaattagtttaaaagaattgatgcaggtgctgcgcaaacgcctttccatgatcgcactgattacactgggggcgatgattgtgacggccattgtgacctattttgtggtgacgcctgtctatgaatcttcgacacaaatccttgtcaataaagcaagcgatgaccaatcgatgtataccaccaatgccgtacaaacaaacgttcagctggtcaatacatataatgtgattattaagagcccatcgatcctggataaagtgattgacgaactgaaactcaacatgacaacggacgaactgaacaacaaaatcgaagtcagcacagagcaaaattcacaagtctttactttgacggtaaaagatacaaacccgtatatagcaaccaaaattgccaataaaatcggggaagtgttcaaaaaagaaatcaaatccattatgaaagtcgacaatgtgaccgttatttcgaaagcacaagtgcctacgggacctgttagcccgaaaccgttgctgaatattgcgattgcacttgttgtcggcctgatggtgggtgttgggattgccttcctgcttgaatacctcgacaacacgattaaagatgagcaagatgttgaacaaatgttggaattgcctgtccttggcgtgattgggcagattgacgatcaagaactgaatggtttgaaccgcgcaggaaaaaaaacaaaaagaaaggttgagacggttggcgcctaaaaaaacaaagctgttgaacacaagaagaaaattaatcgcaaagctaaatccaacgtcaccgatttccgaacaatttcggacgatccgtacaaacattagtttttcttccgtcgacaatgacctgcagcttctaatggttacctcaagcgggcctggagaagggaaatcgacgattgtcggcaacctcgctgtcgtttttgcccagcaaggaaaaaaggtgctgctcgccgatgccgatttgcggcgtccgaccgtccattatacgttcggcatgaccaatacgtttgggctgacaacggttttgaccaagcaggggacattgctggagactgtttcaaaatgtgatgtggaaaatctgcatctcctgccgagcggcccaattccgccaaacccggcagaactgttaagctcacgggcaatgaaggaatttttaaaagaagcaaaagaacaatacgatatcattttactggatacgccgccggttttggctgtcaccgatgcgcaagtgttaaccaatcagtgtgacggcacgattcttgtcgtctcaagcggaaaagcggaagtagatgctgtcaaaaaaacgaaagaattgctggaatctgcaaatgccaatctgcttggagtcgtcttaaacaacaagaaaacccaaaatacgcattactattattattacggaaaagattgacaacatttgcgtgaaaattttccaatcactattgaaaaatggtaagaatgcactataattttgtatagagtttggttttcattgaaacggaatttcattttttcacatgtttggaggggtacgggatgatggatatccattgccatattttaccaggcattgacgacggtgcgcaaacgatatacgacagccttgatatggcaaaacaagccgtctcccaggggatcaagcagattattgctacccctcatcatatgaatggaaaatatgaaaaccacaaaactggaatcattcaaaaagtaaatgagttaaataaaagattgaaagaagaacagattgatctggaaattctgccggggcaggaaaaccggatttacggcgaaattttgcaagactatgaaaaaggcgaaatccaaacgttggccggcacttcttacctctttatcgagttcccttcaggccatgtgccacgttatgcggaaacgcttttatatgaaatacaagtgaagggcttaatgccgattatcgtgcatccggagcggaacgcagagctaatccagcatccggaacggctgtatgaaatggtgaataatggtgtggcgacccaaattacggctgcaagcttaacaggcgctttcgggaaaaagattaaaaaattcaccgaacagctgattgaagcaaatctcgcccattttcttgcatcagatgcccataatgtgaaaacccgtgcttttaaaatggatgaagcaacggatgaactcgaaaagaaatacggcacagatatgctctatttctttacggaaaacgccgaaatgcttgccaaaggccaagccatctacagagaaattccgcagccggtaagacaaaagaaactgttcggtttgttttaatcggctttttttggtattccgggtatatgaatgaagctatgggggctgctccgctgtttttgggaaacagttttatccagcgttgcttgattttggaacagctattttcgggtatgtctctcatccgttatcgtgcgaggcactcggccatgctgtgggtgcgcgtgcaccttagacgccagtcgtcaggagtgtggtgtgagggcgggttagatgcccggttccgtttgtttttatacccggatgtttggaagaataaacatcgatgtttttattgtacggcccaaatcttaaaaatgaattaaaataagggggaatttacgtgaaaaaagtgagaaaggcgatcatcccggctgcagggctcggaacacgatttttgcctgcaacaaaagccatgccgaaagaaatgctcccgattgtagacaagcctacgatccagtacatagtcgaagaagccgttgaatccggcatcgaagacattatcattgttaccggaaaaggaaaaagagcgatagaagaccattttgataatgcttgggaactggaacaaaatcttgctgaaaaaggcaagttcgacctcttagataaagtccgctattcttccaatttagccaatatccactatatccgacagaaagaacctcttgggctgggacatgctgtgtggtgtgcgcgcaactttatcggcgacgagccatttgcggtcctgcttggcgacgacatcgtccaaaacgatccgccatgcttgaaacaactcattgatcagtacgaagaaacccgttcttccgttatcggcgtccagcaagtcccggaagaagaaacacaccggtacggcattatcgcacccgcttccaaagaaggccgccgatatcaagttgacaaatttgttgaaaaaccaaaacaagggactgcaccatccaatttggccatcatcggacgctacttactgacaccagaaatctttatgttcctggacaaacaggaaaaaggtgccggcggcgagatccaattaacagatgccatccagcaactgaaccagattcaaagagtatttgcttaccagtttgagggtaagcggtatgacgtaggggagaagcttggctttattcaatcccagattgaaatggctttgcaagacgagacaatcagccaagacttgttaaaaataatgaaaggaattattgaaaaaacaaatacaagtgtattggaaacgaaatagggggtatttgaagtggctgacaccagttatgcttccagttcggttgtaaggtcctctgctacccagaaaatggagaccacaaaaaagattgaatttgaagagaaaaaaacctatacaatgataaaacgtgggatggatataattggtgcaagtatggggctcatttttttatcatggttatttttaattgttgctgttctcataaaaattgaagaccctaaaggaacagtcttttttaaacaagtacgggttggaaaaaatggcaaaaccttttatatgtataaattccgctccatggtatccgatgcggaagagaaactaaaataccttttgaaatacaatgaaattgaaggtgccatgtttaaattaaaagaggacccaagggttacaaatattggcaagtttatccgaaaaacaagtattgatgaacttccccaactttggaatgtgttaaaaggtgaaatgagtttagtcgggccaaggccaccgttgccgagggaagtaaaagaatacactaattatgataaacaaaggttattggttattccaggttgtacggggctttggcaagtgagtgggagaaacagtttgagctttcaagaaatggttgaattggatttgcagtatatcagaaaacgcaacagctattttgatttaaaaattattataaagacggtctttctgttattcggttcaaaaaatgcattttaaaaaggtgtgaatgacaatggaaaaagcagcaagaatctacgtagcaggtcacagggggctagtcggttctgctattttgagaaagctacaggaacaaggatatacgaatttagtttatcggacaagtaaagagctagatctgcgggatgccgtagccgtaaaggaattctttgatcaagaaaaaatagaatatgttttccaagcagctgcaaaagtaggcggcattatggcaaacagtgaatatcctgctgatttcattcgggacaacttgatgattcagacgaatatcattgacaatgcataccgtcatggtgtgaaaaaattattgttcttgggaagcacttgcatttacccgaaaatggccccgcagccgattaaagaagaatatttattaaccggcgaactggaaccaacaaatgatgcctatgcgattgccaaaattgccggcattaaaatgtgccaatcgtacaataaacagtatggcacaaaatatatctctgtcatgcctacaaacttatacggaccgaatgacaactttgatttaaaaacttcccacgttctcccggctttaatccggaaattccatgaggcaaaagagaacaacgcgccatttgtggaagtatggggaacagggtcaccgcttcgcgaatttttgtattccgatgacttagccgatgcgtgtgtttacttaatgaatcattatgacggcgatgaaattgtgaatatcggagtcggaaaagacttgccgattaaagagcttgcagaaaaagtaaaaagtgtagttggctatgaaggtgagattcattttgatacgaccaaaccggacggtacgccaaggaaactggttgacgtgacaaaactaacatcacttggttggatttccccaacttcacttgatgaaggattgaaaaaaacttatacttggtttttggaaaacaaagaatcgcgtgttcgagtataatggaggataagatgaagaaagcattaattactgggattacaggacaagacggatcatacttagcagagttactgctggaaaaaggctatgaagtgcacggcattatcaggagaagttcttcatataaccaagaacgtctggaagatattatgacacaagaagaagccgaagcattaaaaggccatcaacgtttttatttgcattatggcgatgtgacagatgcattaaacattacaaaaattattggcgaaatccgacctgacgagatttataatctggcggcacagtcccatgttcgcgtttcatttgatatgccgggttatacgctagacacggatgcaaagggaacgttaaatattttggaagctgttcggattttagggttaactgaaaaaacccggatttaccaagcttcaacatccgaactatttgggaaagtccaggaagttccgcaaaaagagactacacctttttatcctcgttctccttatggtgtcgctaaattatatggctattggattacgaaaaattatcgggaatcgtacaacatgttcgctgtaaacggcattttgtttaaccatgaatcagaacgccgcggagaaacttttgttaccaggaaaatcactttagctgcagcaaggattgctcagggaaaacagaagaaactttatttagggaatctggattctttacgtgactggggctacgcaaaagactatgtagaatgtatgtggctgatattgcagcatgataaaccagaggattttgtgattgcgacaggtgagatgcattcagtacgggaatttgcagagctggccttcaaatatgccgggattgagatagaatggataggaaaaggaatggacgaaaaaggcatcaataaaacaactggcaaagtcattattgaggttgaaccaaaatttttccgaccagcagaggtggaacaattgttgggagaacctaataaagcaaaaactttacttggttggaatccaacaaaaacatcatttgaaaaattagttaaacttatgacagaaagtgatatgaagaaagtttcaaatgaagataaaacaaaattaatgtttgactaaaagccaatagttagcacgaatggagttatggcatgaatttagatcatgaaaagaaaaaattactcatgtatgcccattattattatcctgatgtagcgtctactggccagatattaaaagaactggcagagggaatgctggatcattttgatattaccattatttgtgtagtaccatcatacacaggtattattgatccatcttataaaaagaaaaagtattatagagaagaaattaatggtgtgaaaataattagggtacgagtacccgaatttactaaagaaaacaaattaagccgtataaaaaacattgtagcatacttttttagagcattatttgcaacatttaaagttggaaagcaggattatgtttattctatttctcagccacctattttaggtgggttgattggtgtttttggaaaatggattaaacatgctaaatatatatataatattcaagattttaatccagaacaaacaattgcagtaggatacagtaaaaatgagttaattttaaatataatgatgtttttagataaattcagttgtagaagtgcagataaagtcattctagttggccgagatatgatagagactttaaaaaagagatttactcaaaaaaaaacaatttcaaatgtaaatctcccgagtcatgtctttatcaataattggataaatgagaaagatatttatcctttagatcctgaaaatgaaggagtcgtcaagtttaaggaacagtatggattgcaagataaattagtttttatgtattcggggaatattggactttattatgacttggaaaacctcataagagtaataggaaaattcaaagacaattcagatgtagtttttgcatttgttggagaaggttctgttaaagaaaaactaatgcagtataaacaaacaaataaacttaataatgtagtatttattccatatcaagaaaaggctgagcttatttacagtctaaatgctggagacgtgcatctggtagttaatacaaaaggaatcaaaggtgtttccgttccaagcaaattatatggtgtgatggcggctgggagacctgtgcttggtgttcttgaaaagggttctgaggcaaggcttattattgaagagagtcattgcggatatgtgactgacccacaaaattatacttgtgtcgaagaaattatcgagaaaattataaatgaaaaaaacaaagagaagttagaaagtatggggaaactaggaagacaatacttagttaaaaatttaaccagagatgtttccattaaaaaatacattaaagaaatagaatcttgttagaaaggggacgtgctatgaatagtaactggtttaaagttttaatgaaattaacgaaagttcaatatgggaaaaatctattactaaaaggaataccgattattttcaatcaaaaaggtgcaaagttaatgattggtaataacgtcactattaagtcgtctttcttatctaatttaataggtctataccaacgaactattatagttacaaggactcccaacgctgaaataagaataggagataatgtaggaatctctggagcaacaatttatgcccgaaaaaaaattacaataggagataatactctaattgggggtaacactaagattctagataatgactttcatcctgttaattctgaaattcgtaaaaaaacgccaaatgataatataggagttcgacccatagagataggtgaaaatgtatttattggttgtaattgtcttatattaaaaggctctaaaattggaaaaaatactgttattggtgctggcagtatagttagtggtgaaattccagcaaattgtgtagcagcgggaaatcctgtaaaaataattagaaggattatacccaatcaaggtgcaaactaatgcttaaaaaaagaatatgtattattgcgcagtttccacctccagtgcatggattatccaaagcagttgaaacgctatataattcaaggttggctaatagatttattttagataagatagatatttcggataacaaaaaaattataaaaaatctattcaaaatttggctaagtaaggcagatttgttttatttcacattaagtcaaactaaaggtggaaacgtaagggatttaataatcttacaacttattagatttaaaaaaaagaaatgtattgtacatcttcatggcggatattatagaagattagtagataatcaaatgaatttttatcaaaagaagtggaactactatgctattaaaagcttaagcggagttatcgttctgggtccctctttaataggaaatttccgaggtatgataagtgatgataaaatatttactgttcccaattgtgttgataataaatatttgattactaatgaagaatttgaaaataagatatcgactctagagggtaaagatgtttttcaagttttatatcttagcaattttataaaaagcaaaggttataccgaagtgcttgagatggctgtaatagaaaaaaaacgagtgacaagtggtggaaaaagagcatttcactttaactttgccggaaaattttttaacagaagcgataaagaattcttctttaattatattaaaaataatcaactcgaggactttgtgacttaccacggtgtagtagatggatctaagaaaaggaatctgctaaaactctgtgattgttttattcttcttactagatatccaaacgaagggcaacctatagcaattttagaagcaatgggtaatggtatggtagtcgttacaacaaatcatgccggtataccggacattgttagaaatggagttaatggaatagttgtgtcaaaaaaccaaatcaatgtaagagagatttattgcaaaatatataactcaaggaatcaatttcataaaacaataaagaaaaaccgtaaagattgtgtcttgctttacaatgaaaatatttatttagaaaaattggaagaaatcttcaaaaaaatatagtattaagatgaattatatcaacttatacctactaaggtttctttaagtttattgagtatggctttaattggtcttattacactaattaggaatttgaaaaaaggaaacatatttaatccataaaagattaaaaggtactattcaagtattaaaatttgttaactgtgagatagattttattataaacgggccaattcgatatgaattattgagaagaatatttgaaaaagaactacacaaaatatttaatggcattatgctggtactctttattcagaacatgtaattggtaacctaaaaaagaacatgtttttttatttcctacttttggagaaaattatggacatgttatacaaaaggctatagtctgcgggctgatattgaaatctatgactgaaaaagtaaataggactattttttatgtaaatgaaaagtagaaaataggatatagaccaatattttattattctaactttaagtaaagtttttattgtattgttaattaatatttggatgaatagattaacatagatgataaaaggactgatattatttaaatgaaaattactcatttatgtttatgtggacctgttacagataatttttcttatcaggataatttgctacctaaataccacaaaaaaattgggtacgatgttagtgtaataacttctcagtttatatggaacgataagggaaagatagatattgattcaagggaaatatattacaatgaatatggaattaagactataagactcaaacttttttttggtaaaagtattacaacaaagtttaaaatatataaagatttaaataaatatctagaatttgaaaagccagatatcttgtttattcatggagtacaattcttaaatttaattgaagtagtaagatatttaaagaaacatcccaaaataaaaacatttgtggataatcatgttgatttttctaatagtgcaagaaattgggtgtcaaaaaatattcttcataaaataatttggaaaaggctagcaaactatatcgagccattcaccacaaaattttatggtgttttacctgctagggttgactttttggtgaatgtatatggaatacccaaaaaaaaggttgatttattggtaatgggtgctgatgatgagcaaattgagctttcaagtaaaataagtgaacaaagtagtatcagaaaaaaatttggcatagcaaaagaagattttttaattgttactggtggtaaaattgatgcatttaaaaagcaaacattattactgatggaagctgtatcaaaaatagaaaataaaagggtaaaattaattgtctttggatcagttacagccgatttaaaagaaagggtcgagagtctgtgcataaaaaataaaatacagtatattggttggatcacttcacaggaaagctataaatattttgctgcggcagatttagttgtattcccagggagacattctgttttttgggagcaggtggctgcacaaggtattcctatgctttgtaaatattgggaagggacgacacatattgacgttggagggaacgtaaagttcctatatacagacactgaaaaagaaattagagataacatcgaagatttagtgaataatagaaaacattatgatgatatgaaatatgtcgctatgaagaaaggaattaaaattttttcatataaaactattgcaaaacgcagcattgaaaattaaggttaaaaaatttaaatggataatttcacgcgtaatatgtatgtattaattagtagttttcaaagatatatggtattggtatactaatattattaaaataaatattaaatataacacatagaattaataaaaaatctttgttgggtggatataaatatgtttcatactaaggatacaagtttggttcgaaataatagaataaaccagtgtaataaatcaaattcaaatacaatagattttattttaatttttgcgattatttatatccaatattcattatggtttttggaatacagtgctgcactccgcatcttattaacactaagtttaattggcatattattaatatctcataattttagtctctatataaataaaaaaagattaatcatacttactcttagtctatttttaatattattaagttgtttaattaatgaagtaaatatacaaattgatggttggaatattgctatttggttgtgtgcttttataattacatcaatcattaaatctaatatattttatgaaacatattctaaaactatcagtattcttgcgctatttggcgtaataatattttgcttatcattatttttgccaagtatttttctaaattttcctgttttaaacaaacaaagttggacgggtgatacagttgttaataatgcatttttttgtaatgtatcattattttcaaactataaaagaaatttcgggatattttacgaaccaggtttattcgcatttcatttaaattttgcccttttcttggaactttttttgttagaaaaaagaaatattaagcgcataactgttcttctaattgctttattaactactctatcaactagcggatttataactacatttttctttttactttcattttttatgaacaatcataataagtttgataaaaaaattataaataaacttaaaggtattagttcactacttatctttattgcaatttttacttttatttctcataagtcaatatggatatttttaacaaataaattaatggaacttaacgataatgcaacttcgggatctggttttgaacgttttcgtgctttaaaactgtcagttgaagcattttcaaaaaatcctttattaggtaccggaggaacaggttggctaaatttgtttaatggatatatagcaacatttacacctatgaactggtttgcattatatggtatattatatgggctattatgttttgttttatttttcaaaataattttcgtgaaaaataataaatttgtgtctagtttactacaattttgtggtttgttaacattaattgcatcccaaaatgtatctaattaccttattgtaataatttttattttgtataatataaatacaaacataaatatatatacaggaaatagtattgcacgaagaagaactatttaaaggggggattaaaagatgatatcagtaattgtccctatttataatacagaaaaatatttaactcgttgtcttaaaagtataacaaatcagacatatgaagatttagaaattattttggtagatgacggttctacagatgattcttttttaatttgtgaggaatacgctaaaaatgattctcggattaaattgttacggaaaagaaatgaagggcaaggttcagcgagaaatttaggcctagaagtatgtaacggggagtatattggttttgttgatagcgatgattatatcttacctggtatgtatcaaataatgttagagcatattaaaaaatataaggcagatattgcaatttgtgggatgtcgagagaccatggatttgctttaagagagatgcctatgccagataaatttcaaatatataataatatatcattgatgaaaaattatataagtactcctcatattacgtcaagtgtgtgtaataaattgtattctagaaaactatgggaaaatgtttattttccttcaatcagagctagggaagatgtaagtatattatataaagttcttgcaaattcaaaatgtgctgttcatgttggatcgtgtcaatatattcagtatgttagacctgggagtacagaaagaaaaaaatttgatgaaaaaaaactcagtgcaattttagctagcaagtctaatcaggaatttattgagtctaagtatccagatttaataaaatatagttttctaagagttgcagatacttatgctagtttaatgcaagagattatatcatcatttcagtatttagataaaaaagatctgtatagaaatttatataaaagccttacaactgaattaaaaagtaaatacgaactaaagtatctagatactgataagtataatcatttgcaagatatagtagaaaatcaatttttattttttttacgaagttatttatatggtttgaaaacactagtagttaatctaatgacgaaaattagttttcaactaaaggagaaataagtaataatgcttatatcaattatttcagtttgttatagagcaagaattgaattagaagaaactattaaatctgtcctaaagcagacatattataatattgaacttataatagtggatggtgaatctaatgatggaactcttgaaatgattaataaatatttattggaattcaagaaaaaaggaatagaggttcgtattattagtgaaccagatagtggtatttatgatgcaatgaataaaggaattcaaattgcatcaggagaatggtgtatatttatgaatgcgggagatactttctatggtaatgatgcattgacaataatgtcaaagtactgtaccaataattatgatattatatatggggatgcagcacattgttataataataaaataaaaattattaaggcgaagaaaagtgctgaattgacttttataaacggtatggaattttgtcatcaagcgacacttataaaaacagctaatttaaaaaaaagaggttatgatatcacatacaaaattgctggtgattatgatttttttgtgaatgcatatcgcaattttgctaacttttaccatgtaccatgtacggtggctgtttttcaaaaagatggtataagctcaacttatgcgggattagtaaaacttgaaaatgcaaaagttaaatataaatatagtcttattaataaaaaacagttttttttggaattaataaaggcaagaacatttctattcatacgtaatatattaccaaaaaaaataattatgacacgtcatgcaatgataatgaaaaggtcaactaagaattgggaattatataactataaaaattgaactaatcattttcgctcaatttcttggtccattttcggagctacagtttgaaactatagcaaaggaagaaggacaatagtgaatcaggaaatcgaataattacaaagtgcatgcagaatacaaagggtaaacttctctttgagcgttacctctctgtgctgctgtatatataagactgtacttatttggacaacagcaaaattcataaccataaattttttagtgattttcttaaaggatatcactaaaggcttaggttgtgtttttttgcaaatatagccctgatctaatcctagtggaagggtcatggaagtggctaaatttatggatcaagccagtcaaagaagccaggaggttattaatcggcaacctgttagattagagctattcaaaacttaggtttattttatataacaaattattaaattattctcgggagattatatggaaaagtctatttcaattaaaaaaaatatgataatgaatattatactaacaggttcaaattttttatttcctttaataactttttcatatgctgcaagaattttacagccagaaggaactggaaaagtagcatttgcaatgtctatgttatcatatttttcatggatagcgacattaggtattccaatgtatggaataagacaatgtgctaaagtacgtaataatagatatgaactttcaaaatgtgtccaagagctatttactattaacattttttcaacaattttagcttatgttgttttatttgttgcactttttattgttccagaaatgcatcaagaaaaagagttatatgttgttattagcattcaaatgctacttaatacaattggtatggaatgggtataccaagcgttagaaaaatatagttatataaccataagatcgattatttttaaatgtgtttcagtagttttaattctagtattggttaaaaacccagatgattatatattgtatggtggtttaaacattattgcttcttcagcctcgaatatagttaattttattcatatacgtaaatacgtaagttttacaccaataaaacataaagaatatcgcaaacacttaagacctattatgacattattggcttcaacagttattataactatatattctaactttgatgtagtaatgattggatttttaaagggtgataatgtagtaggtatgtataatgcggcattaaaaattaaaaatatcgttttatcgacatcaactgcaatcaccgcagttattataccaagaatgtcgacctattaccagaataatgatattaataaatttagagagctaggtttgaagtctctaatggtatcaacgatttttgcttttccgcttgcgacattcatactaattaattcatctgatgtattaagttttatttctggttcatcctacatccctgcttctaacacattacgtattttaatgttatgtacttatgcattaattatcacaaacctatttggagttcaatttttaataccaatgggaatggaaagtcgatattcacagagtgtatttataggtttatttataaatattattttaaatttccttcttataccaagctttggttcagctggtgcagctgtaggaactttggtaacagaaatatttaatgtatattggatgagtaaaggtataccaaaagagagaaactttataattaagagttataacttccggccatatttttggggaatatttgttgccgtttttttaaatttcatagcgatactcttaatgcctaactataatacttttttacggcttattattttatcatttatattttttggagcttactacgttacacttttgttattaaaagaatctttactactaagtacttataataagtattataaaaagatgatgaaaaaaaataaatgaacgtgttctactttccaatggtttgtaaaaaaatataactactatcaaacgacactaggtaaaataattcttgaaatttttataatgtaaaaatgaaggattgcagtcaacagtacaacgaagttataggtacctattgttgctcaaaatttataaaaaagaaagaattacttcaaaggagagcaggtggtcctttacgtttcttacatgatttattttggagacactaatgttaataccttacgtggaacggtacaccactagatcttaattgtttccaaacactccgatttaaatcttcaattgatttattcgagatttgctgagtatattcgaatgggatccaactgtcttgctttggttcctttttaattttattgaaaaaatcctttttatgttgaattaacaataattttttacgaacagatgataatgatttttttacggagggatagtatgaaactcgtgttgctttcaggtgggtcaggtaagcgtctatggcccttatcaaatgacacaaggtcaaaacaattcttaagagtattagaaagtgatgaagaaaagcaatcaatggttcaacgtgtatggggacagttaaaaacggttggattggctgaatcatcggtgatcgctacgtcaaaaatgcaaagagatatgattcatagccagctagggttggatgttcctcttattatcgaacctgaacggagggatacctttccggcaattgctttagcttcttcttatttatattcagtcggagtatctgatgatgaggtagttgttgttttacctgttgatccttatgtggagaatcgcttttttaataatataaaagacttggaaaatgtgttagaaaccacgcaggctgagttagccttggtaggagtaaggccaacttatccatcttcgaaatatggttatattgttcctgaagaggttgttgaaggagctcgttattttaaggttcatcattttacagaaaagccaagtgaagaaaaagcgcaatccctcataggaatgaatgctttatggaattgcggggtttttgcatttaaattaaaatatttgattaatattttattagaaaaacaattgccagttgagtatgagaaattgttacaacagtaccaacttcttcctaaaattagttttgattatgaggttgttgagaatgcaaatcacattgtggcacttccgtatgatggttactggaaggatctcgggacatggaataccctaacagaagaaatggctactacacaaataggaaaaggtgtcctaagtgacgactcggtgaatacgcacttaatcaatgaactggatattcctgtaacggtcataggaacaaaagacatcgttgttgctgccagtccggatggaattttagtatccgataaagcctcaagtccaaaaataaaagattttattagggaatttaaccaacccccaatgtatgaagaaaggttatggggatggtcacggacacttgattacgccaaatatgatgactgtgagatggtgacaaagcggattcatattacaaaagacagaaattctacgtatcactatcataatttccgcgatgaagtctggacaattgtgagtggagaaggcgagcttgctttggatgaaagtttaacaagagtgaaatccggggatatcattcatcttcctgccgggaggaagcatgggattcgagcaattaccgatctggaattcattgaggtacagacaggcgaagccattagcaatgacgactttgttcggatttattatgaatgggaagacgttattgaagcttataaccatacaaaagcgaaagtaatatactaggttgaagaaaaggttaaggaaatatagttttatacatttaggagatgcttaaaatgatcaatatcgcagttgctggtacaggttacgttggattagtcacgggtgtatgtttagcagaagtcggccaccatgttatctgcgtagataataatgaagaaaaaatcaacttacttcgacaagggatttgtcctatatatgaaccggaattagacaagttgatagtaaaaaatattgaagaaggaaagctctctttcactaatgatttcagaactgcttacgtacatgcagatgtaatttttatcggcgtgggaacgccggaaaatgaagacgggtctgccaatttaaattacgtttatacggtcgcaagagaaattgctgaatccgttgagaaaaactgccttgtggttgtgaaatcaaccgtaccaattggaaccaatgataaaattgaaacttatatcaaaaaccatttaaaacacaatgtcaaaattgaaatcgcctctaacccagagtttttagcacaaggaacggcagtacgtgatacacttcatgcatcccgaatcgtaattggaaccgaaagtgagtcggctaaacaactactaatggatgtctatgacccattcaaactgccgattcttcacatgaatcgacgcagcgcagagatggtaaaatatgcatcgaacgattttcttgcattgaaagtttcttttgtcaatgatattgctaacttgtgtgaaagagtcggggccgatattgaagacgtcacaaacgggatgagttacgatgaaagaattggcaaccgatttttaaatcctgggattggttatggtggctcttgcttcccgaaagatacaaaagctttacactggcttgcggaagaagaaggatatattttaagaaccgtgaaagcagccattgatgtgaatgaaaaacaaaaatatgcactcatcaaaaaagcacgcaatgattttccaacttttaacggaaaaaaagttgcagtattggggctcacctttaaacccggaacggatgatttacgtgaagcaccgtccattccgaacatccgcttgctgctaaatgaaggggcgcgtatacaggcattcgatccggttgggatagaaaactataagaaactgtttcctgatcaaattgcttataaacactctattgaagaggctttggaaaatgccgatctttgctttatctttactgaatggccggaaatcaaagaaatggatctggatttgtttaagaaacagatgaagactccgcatatctatgatggccggaactgctttagtctgtgtgaaattgaaaataaagggattaattaccattcaattggccgcccgagtgtcgttgaattcagcgtactcgatgaagttcaggcgtgaaattaaaacggagcacctcaaatcagggtgctctttttttctgcatttattctataatttgtcaaatttttttcggaaaatagcgggaagggttgataaaataaaagagaaaacaatgatacgcatgttttttaaaaaatgaaagcggaaacaggtatgttgtcgcctatctgaacaactttaggagatgttttcattgacaaaaattacagttgcaggaacaggctatgtgggtttatcaaatgcagtacttttggcgcaacataatgaagtcattgcgcttgatattcttcaggaaaaagtggatatgatcaataacaagcggtcgcctattgtggaccatgaaatcgaagagtatcttgcaacaaaagatttaaatttagcggcgacaactgataactatcttgcttataaggatgctgagtatgtcatcatttctaccccgacaaactatgatcctgagaaaaattatttcaacacgagaacagtggaagctgtaatcgccaatgtgctttcaattaatccaaatgccattatggtgattaaatcgactgtaccggttggatatactgaaatgataaaagaaaagtttgaaacagacaatgtgatcttttctcctgaatttttacgtgaaggcaaggctttgtatgataacttatatccttcgagaattatagtgggagagcaatcagaacgggccaaggtttttgcgggcttattggctcaaggtgcaattaaagaagacatccctgtattgtacacaaacttaacagaagcagaagctattaaactatttgccaacacttatcttgccatgcgggttgcgtttttcaatgagttagactcatatgcggaagttaggggattaagcacgaaacaaatcatagaaggagtcggccttgatccgaggatcggcagccattacaataacccatcgtttggctacggcggctactgtcttcctaaagacacaaaacaactactcgctaattacgagaacgttccgaacaacatcatgcaagccatcgtcgatgcgaacagaacaagaaaagaccacattgccgaaatgattatcaagaaacacccgaaagtcgtcggcatttaccgcctcactatgaaaactgactccgacaacttccgagaatccgccatccaaggcgtcatgaaacgaatcaaagcaaaaggcattgaagtggtcgtgtatgaacccgtcctgcatgaagagaagttctttaactcccgcgtagttaataatgagttgtgtggagtatttacacatagttatatccattgctaatatacaacactctccggaggtgcgggaatgctggataaaattgaaggcggtttatttgggctggcagtaggcgatgcattgggtggaacaacggagtttatgtcggaacgcgaaattaaagagcgttacggccgaatcaatgagattatcggcggaggatgttggaatttaaaacccggtgaaacgactgatgacacgaattgacgatctgtgttttgaaggggatcattgcaaatccccaaaattcaatcgaggaaatcggcaaggaatttttgcggtggtgggagtcggacccgaaagatattgcaatacggttcaaacggctttcaattgttatcagggtgattggtttcaggcgtcggaagaagctcatgatgaactggacgggaagagtgcgggaaacgggacattaatgagatgcttgcctgttgcgcttgcatatttggatccgcaaaaaatagatggaatctcagctctgcaatccaaaatgacgcattatgacgatctggcatctgaggcatgtgtcatttataatcgcatcgccagcaggctgatgaatggtgaagcgttagaaccggccattcaggtggaaatcaatcatacccggtacgcatcaagcggggtgcagcaaccggagtgtctgccggatggatatgacgtccacacaatggaatgggtattctattggctgttgttttcgcactcatttgaagaggtcgtcaccggtgccgcaaacatggggaatgacagtgacaccatcgccgcaatcgctggcggcttaaaaggaatagaaatcggctttcggcaaatcccgtatcggtttacggacaaaattgttattaaaggacgacctccatgcttatgcaaaactcctgtgtgagatgagggaccaggactcgcgtgtcatgtaggcaaatggagaaggacaaattggctgctgcgctttgatcggcgtttattttttagtataaaaacaatcaagatgcgtactgcttaaaaaagtttcacataaccggccgcctggaacaactgaaaaacacgatgaaccattatattgtgcaagaagcctatcaaagtgtaaatgcataaaattccgaaccggtctgcctgtttgaaggccggccggtttattcaatggggagattatacgtagacgcactctatgttaaggaatatcgatttttgtgcgcgtttccttcacatagacgcactctacgttaaggaacagcgatttttttgcgtgcttccttcacgtagacgcactctacgttaaggaacaaggcattttttcctcgcttccttcacatagacgcgctctatgttaaggaacatcgatttttgcgccagcttcctttacatagacggactctgtgcgcgtggtaaagcaccaaaaacatgaaacttctgattttcttgaacccttttctgagccatcaagaaccgttttcccggaccgtcaaattcccctcaatcaagcattagccggaaactggccgagcactttatgaagccaggaaacgctcaggccaaaccattgtgcaacatctgcatccacatttgcttttaatccgtttgaagtgtggggtttggcgagcgacaacccgtgcttgcctttttgaaaaatatgcgactcaaatggaatgccatgcgcattcaacgcctgcaagaaggcaattgagttttcaatcggcacggtttggtcttcaaaagttgaaaacagaaaaaccggcggcgtttcggcagtcacttccttgtcaacagacggcaccggaaaagcaaggctttcgctcatcgaatccaaaatacatgggtagcctaaaatcaaggcattgggcttatttttcccgatcgtaccaagtgcagcagcaagatggcctcctgcagaaaaaccaacaactgcaattttttcagggtcagtatgccagtctttcgcatgctcgcggatcatcgcaatcgcttcttccgcatcttgtaaagccgcttcaaaccggaatgtttccccgaccgagtagcgcagtacaaacgcgttgaatccttccgccaaatatgccattgcaaccggttccgcttccctgtccgaggtaaaccggtaggcgccaccgggaaaaataagcacagccgggcgcgcctcgatattgctgaactcaggggatccgtccagcacatacgctgtcagttcagcattctgatgcgcctttaaacgtaaagtttctgtcttcacaacgctctcctccttctccccatttgtgggacggtttcatttttacagtagcactggccattacaaaaaacaacgaaaacgttcctgtatatcctgccccgtttaaaacaaaataagattggtttaaaaaatgaagtggaggttgaatcatgaaattagccgcacatgaactgtacgatttaaatgaactggcgatgagctgtgtcaactcgattacgaacatggcatatatgctccagcatgtccaggatccggcgttcaaaaaaattctggaaaaacattttccgctccatatccgggactacaacatgaaagtcgaatttttaaacaaagctgaaggggcaaaaaaagaattgccgttgttaaaagaaaaccaagagatttccaacatggcactgcaaatggccccaccggctgtccctgtccagccgcggacgatggttgaagatatgaacgaccgcgaaatggcaactgcgtatttgttaacgctgaaacgggccgggcgggaatatgcatgggcggcgatggaaatggcaaatcctgaaatccggtcgttttgccagactgcctttatgatgagctgcgcccacgcctatgacatgtggcagtatatggcatcgaaaggctactatccggttgaccaggcagaatctgtggatacggcaaaaatcggcgccatgtaccaagttgttccggaaaaccagccgcaaatccagcagtacatggcacagtcccagaatccgactgccggagacagcgggcaattgtatcaataatggttttactccagtaagcccgagggtatcagtgattagcctattgcggaagcagctgcttctgcaataggtttatttttctatcatttaaaactaacttacgtaacaaaaagaagagaaggtattgaactactctgcacaatggaatgcctatgaatgccgggctgcatttgatccggctgatgaccgtttcacatttatcgagaatggcgtacaaaagctttttggctggtccagaggggccggtgttacagcgatttgcgcagatgctggaaaaaacgccgcacggacatacattcggaaaaatgatttcatctctaagccgattccttgaactcctccccttttcccggccataatgtgtttgcggagcttttgtccaattggaacgcttaactggacaaatcttcaggggcgcacggggcttttgtctaattagaaccgctaacaggacagtcctacactgccgcacggcgcttttatccaattagaaccgctaacgggacagttcttccgcggcagcaggagcttttgtccaattagagcagccaacgagactgttccacgcgggctgccagcgcttttgtccaattagatcggctaacgggacagttctactccggccgagtcaagtgctggttattgtgtaaattgcatttggggctgtgcatggcagtccctgtttttcatcaaaaacgaagggaatggctgatttgttatcttcactgaaactgatcgcaaaagcaaaagcgggaaatacggatattctccacgaacataaatggctttcatacttgtaccgtacagacgaaaaaaatgtgaacctcgaacaagtcgaatcattggaaaaccttgaaccgaatccggtcctgcactatgttgaaaaaacgctagccatattggaccgctgttatgcagacttgcccgcatctgaaaaagaaatcattgaggaagttttaagatggagcgaggtggcaaaatgcgggtctgcccaaaagcgggaagaatggcgcaggcgcggttttcaattgcgtatccataatatcggatcagcgcggatttatgcccatgaacaaatggcggttccattcgggcagcgtcatttgcaaaaagaagacctgatctatacgctcatcctgacccacggccttgtcgggcagtttatcaggggagaagtccgctaccgccagctgtatcctctaattgattggatccaaagccaccggtcatctttaaaatgggatatcaaacgcattttgcttgccctcaatcactgtattattgaaggggtatcccccgctatatgggaaaaagtccgtgcagaaacttcacaaatcacaagctggattgccgcgggagaaaaaagccgggagcattcccttaaagaacggctcagacgattaagagaatgttccatccaaaaaggcgaggactttgaggctttatacacaaaatggttcagcaaccgggaacttgccagtatgtttcacttacttttccagaaaacggatatttggtatgtggaatccgcactgcaggatttttcttttgaagaattcctgaaaatttttcttctcgtctatcagaaaacaaacctgcttaccgttgagcaaatcagttttgagccgttgatgaaagatatctattatgattacaaagggaaaaaatcggttaatttgtataaaaaaagaattatagaagcgtatttaaaagcttgtccgctagcaggcctgatcagcggagatacgcagccgaacgaacatgttacgcttgaactcattccattcgattcattgggcagtacaaccggcgtcaattttactttttccaaacctggggaaaagctcatcgcattttgccaggaagcagaaaagtcccctctctatgaacgttccatactcttgttgtacgattttttcggattccgtaaagatgcgtttgacaggctgcaaaatgaacagcattatttggcagacatgaacaatgccgaagaccataaaaagatcatcgcagactttgcaaaaggaacggtcatgattgatgttggcgcagggggcgggatcatgctcgatctcctgtccgaaaagcacccggatgccgacattacggggatcgatatttcgaccaatgtcattcaagaactggagagaaaaaaggtccgtgaacggaaaagctggaaggtgaaacaggcagatgcgctcaaactttcatcttattttgagttagagagcgctgatacaattatattttcatctattttgcatgaaatgtattcctatatcccttttcacggccggacatataacccggatgtcgtaaaagcggctttaaaaagcgcctttgccgtgctgaaaccgggtgggcgcatgatcatccgcgacggcattatgacggagccaaaagacctgatccggttattagcattccgcgatccggacggcttccgctttttcactagatatgttgaagattttaaaggcagaaaaattgattacgagattacagaggataataagatcaaactcccggtaaatgacctgatggaatttctatatacttatacatggggggaggaagcttatccacatgaagtccaggaacaattcggatacttcaccccatctgaatatcggaaagtgattgaagaaacgctcggcagcagggcaaacatcatttgtttccgccactatcttcaagaaggctacagcacgcacctgcttccgaaagtcaaagtaatggacgagagcggaaaagaaaccgcactcccggacagcacctgtttcattgtcattgaaaaggcggaataagccttcatccggactgctccgtgagaagaggctgttacaagcagcctctttgcatccttctgttttttacctaacctattccattctaccgataaaacatactttacaactaggattaattggtttaaaattatgttaacattttaaattcactgaccatataaatgttaggaaggagcttttttatgcatgaatactatcccgttctttcgggtgcagaatccttttttataaaaggaaatgaaattggcattctcatctcgcatggattcaacggcaccccgcagagcgtccgctttttgggagaggcactggcatcggacgggtttacggtttgcgcgccaagattaaagggacacgggacgcatatcctggacatggaacgctgcacttacaaagactggattgctagccttgaagaaggttatcagctgctgaaacggcattgccatgatatttttgttattggccagtcaatgggtggcacactggctttgcatctcgcggaaaaacacccggatatccggggaatagtgtgtatcaacgcggctatccaaagcattcctgaactggaaaaatgcctggcgaaaggacggtttattcaagagggcccgccggatattaaagcagcgggcgtgcatgaaatttcatatgaaaaagtgccggtggcttccatccgtgagcttctgtccgtgatgtgggaaacgcgggaaaacctctccgccatccattgccccgcacttttgttccaatcaacagaagaccatgtcgtgcctcctgaaaatacagagtatattgccgcacatattcatgccagccggaaaaaaatcgtaccgctccgcaactcttatcatgtcgcaacaatggatcatgaaaaagaatggattgcggcccaatgttcattatttgttcaagaaattgcgcatatcgaaacccgtacggaaatatgatgagttttaaatcatgctccaaaagaatgggaggatgctcatttgaaaaattttctacggcacgcgatagagaaaaaaacggcaatatttgatagaacagctgattgctcttggcgcctatcaggaagatgacaagcagcttttcaccctgacattgacggaacttgaaacagaatatgcatacttcagcaaaatcagccaagaaaaagaagcgtccggaagagaatagttttgccggcgcttcttttttgtgtatttttttaaatgcccaaaaacggcatagacgttcctgccacagtaaacgtgacacctttatttagggcttgctgaacgaatccaattctgagtttgtctgcaagctctgtctcaaaatatagcagaattcttttgcagaaatgggtgattttatctgatttggcttacgagtgcaagcttttcaccggatttgttgtaaaactagcatttaaatggttgccaaagctgtcagcatccttgccaaatctaagcagtttgcttattcagctagctctgtacaggttataacagccctacaatttgcagaccgtggggaatgcccatgtcttccaccgattttgtaatgtatttggcggcagcctttaccttttcttccgcatttcccattgccacactgtttttaatcatggacagcattttaatatcatttaacccgtcgccaaatgcatattggcgttctggaggaaagcccaatttttcaacaatcttttcaattcctctcgcttttgacccgccttttggcaaaacatcgacggaaagcggatgccagcgaataaattcaaaatccggaaacgcctgttcatactgtttctcttccccttctgaacagaacaggagcgcctggtacaattcacgccctttataataatgcgggtcatacgcaggcaaccggccaattttcaaagacgtaatgcttttttcaatatcctcgtggtttggcacattggccttcatgtcttcatggtccatgtagacaagcggatgctggtgggaaagggcatatgcagtcaattcttcaagcgattgcctgtttaacggatttttaaacaatacctctccgttcataacaacatattgcccgttataacttacaaaagtatccatcccgagttccttccgcaaatcttcaaacataaacggggccctgcccgttgcaatggctgtgacatggccatcgcttttcagcttatctatcgcttttttggttgtgacaggcagcttcttctcatgtgtcagcaaagtcccgtcgatatcaaaaaaaatcacgcttttttgcttcatattcttcataatcctttcccgttctatttcaagcatactcattttcaggatgccgttttttcattaaagatgctgtaatgacatcataaatcaaaaaactcagcagttcaaataaggttccgattctatccggggtgaggccggcctgttttatgctttcaaattcagacgattcgtccggcaacaagaccgtcacatccgccatttttgcaagggttgatgcgggagaagccgtgatggccacaatgtttataccgtggagcttggcttttcgggcggcattcaataaaacgggattttctcctgattttgagctgaacaagatggtatccccttttttaggaacaggggaaattaagtcgccaatcatcccaacccggaaccccaaatggaccagcctgttggcaaagacacggaggatcatttccgaacagcccgttcctgccaaaaacaaacgattcgaccgaccaatcacctctacaacctgctctaatggttgatcgtctactttactgcacaaactggcatacagttctaaaaccatggcctttgcatcttccagtatattcacttttctccctccccgtttgataaagcacaagcatcccttttgcggcactgctgcagacgccgtttttgttttggcaggctgaggttggccgggctttacacgcggcaggacgaaacttcccagcctatatccctataccgtacctctttcaatgagtgttgctgagatttccttgtttttaatttcctttgtcaaaacctggtggacaaggttccggcccatttcaacaagcggaatatctatcgttgtaatattcagcattccggcaatcggttcattgtcaaatccgatgatcgccaactcatccggaatagaaatttgctgtttgttgcaactgatgacaatccccgctgcaacctggtcgcttgttacaagcaatgccgaaggaggcgggtccatttcttttacccggctcaaaaccctttctccatcctcatagtcgtagcattggtcaaaaatatattccggatggtgcggcaaatggtatttttcatggaaatcccaataggctttatcgcgattccggctgttggtgccggatttcctgccgatgcaatacccgattttcgtatggcctttccggtacaaaaattccagtgcatccataaaaattttatagtggtcaatataggttgacgatatttcgccgccttttacacattcacaaagcgcaatcggcccgaatggcaagtattcttcaattttgcgcatactgcaggcgcgcgaacaaatgattaaaccgtcaatttgcttttgttgcagcatttgtaaggcttccgtttccctgctttccatatagtctgtttgaaacaaaagcagtttatggttatactccagcgcctgctttgcgatccctttcaataaaagggcaaaataaggatgatctgtaaatggcaacacgaccccgatcaattttgttttccctttacttaaatggacggcattgatgtttttatgataccgggtcgctttcaccgcttttaaaacagcgttctttttttcttcactcacatacggatgattgttcagcacacgggagacggtcgtcacagacacgccggccattttcgccaagtctctaatatttgtcataacctcacctattaaaacacttgcgatttttcagcaggcatccatgctttaggatggaagtgtttaaaccaagcccctgccagcaggctcatttttatgtatttatagtgtaaatgatgaaacgcatttcatgtcaatttttatttttgcaaaatccgtttcgatgttgaaacagaaaagcgccggtgaagatgtggacatgcaaaaaagggctggttgctgcagccctcccgttttaccggggaaaaggggaccggcatcccggccggccccttgatctgttcaaaaacccccgtacatgcggtttcatcttctctgctccagttccttcatcatcttcttgtatctgttttctgtaatcggataaaagctgatcagcaaaacagacagcaggatgaaaatgccagggatgatggcattcatgtccttaatcgcttgaagggatgaaacggactgggctacatttggaacatagccggccttgtttaaaaagaacgctgaaaacgaaccggcgagcgcaacacccagtttattggtaaaactcatactcgaaatcaccacaccgtctgcgcggattcccgttttccactctgcatagtccacacaatccgcaagcatcccccatgcgagcgtgttcagcggggtggtaaaaaacccggaaacaaacagtaaaaacaaaatcagtggaatggaggaatatgctgtaaattgcaagccgacataagaaatcagggaaagggctgccgaaatcatcatgacgttcttcctgtcccattttttggacaggctggggatgaagatattgctgatcagcgcagcaccaaaaaataacagcgtccccataaacaccaaatctttgcggtggacattataggtgaagtagtaaaccattgtcgtcaatttaatgttaaaaccgacggcaaaagccaggaaagaagaagccaggatgagcaaaggtttatttcggatcaagacggccaatgttttctttacaccgtgtttttttctggttttatagcgaccctctcccgcactgtcaggaaactgatcaaatttaatgcaaagcttgcggccgcataaacaagcgccgtgagttgaaatccttttgcctggtcatcgccgccgaaatattgggcaagcggtgttgcacaagatatggagagaagaattccgatatagaccaaaatcatcctgatcgttgtcaataatgtccgttcctgtaaattgtccgtcattcttgcagtcaggctgtttaccggtatcgtctgcatgctgaatgacatcccgagcaaaatataggtcacgtatgcataaattctgttgcccgccacactaaaatggggcgttgtaaaacataaaaaagtaaacaaagcaagaggaactgccgcccataataagtacggccgggctttcccccatctgctctttgtcttatccataatgacgcccatcaccgggtcaaaaacggcatccaaaacgcgcacaacaaggaacaaagtgccaatgatagcaggtgaaatcccgtccacatcggtataatagaataacagataggcgtttacgaactggaaaataatattataagacatatccccgagcccgtaaccgattcgttccgtccaagacaacctgccgccggaagcgctcttttgattttccgctgcatggaatcgtactgttttatcagaaaccaacataggtgatacctccgaatgcgttttcaatgattcgttcattcaactgcctgcagaaaaacagacattttgtaccggcttttccttcaaacatgcaaatggatgatggatgcgggtggcttgaaattcatcggccagcccgcatcatcctccccattctatgattcgtgtgacatcctacaggccatcatgatttcgatcctatttttccggtgaaacccatccggcccgcgcatgtagattgcaaccattttctataaaatgaacgaatgatactacccttttcctaaatagggatgcctcgctcttgttataaatgaacggctcagtattttcagttgttcggataaaccatgactttcaggcattcgttcttgaaattcagtgcgcgttccatcgcctgataagtatcttccaaggcatattgatccgtcaccagttttttcacatccgcgatgccggaagccaaaaattttatgccttttggatacgtattcgcataacggaaaacaccgtaaatatcaatttcattatccgcgataaatgggacgttcaacggaatttcattttgagccggtaaaccgacaatggccagcttcccgccgcggcgtacagatgcaagcgctgattggagcgctgctggattacctgctgtttcccaagcaacatcaacccccttgccattggtgatgtcttgaattgcttcataaggatcttgttcgcgaatattgatcgcataggtagcgcccatttcttttgccgcttcaagccgcaatggttccaagtccgttacaataatgttcgacgctccgaaggccctcgctgccacaacagccattaaaccgaccggacccattcccataatcgctacggtcaatcccggttgcagttttgttcttgtggctgcgtgaatgccaacggaaaaaggttcaacaagagaagcctcttcataagaaagcgcatccggaatggcgaacacaaagtcttctcgcattttaatatattggcaaaaagcaccatctacaggaggggttgccaaaaattggacatgtgggcaaagattgtaacgcccttctttacatgcttcacaatgcccgcaagtgacacctggctcaacagcgactctgtcccctactttaaaatggcggacttttgaaccaactgctgcaatttcccctgcacattcatgcccgagaataaacggcttgtccactacatattttccaattctgcccgtttcgtaataatgtaaatccgaaccgcaaatgccgaccgccatgactttaattaaaacttcattttcttcaatttgcggaacaggcaatgtctcaatcgaaatatttcgtgtcccgtgcatcactgctgctttcattgtttcaggtatatggtttgtcatcttcaaagtccctctctttgaaaaactggatttccggaatataccgtgatgaaagtgcattcattttggcatattctgttttcactatttttatcatacaaaacggatgaaaggggaaccagctattgttgctgtataaaaggacagccgcactgtatgttttatgcttaaattttagacttcggttattatattgataaaatataggaaaggaggtgaggtccttggccgaacttgaaaaccaaaaaaagttttccagtctgctatcttccggtgttaaagctttaaaacagcacccggattacaagacaaatagagaagccggcaacaaaaccgggcaatcttacatggaaaaaatcgcatacaaactaggtgtatcccctaacaccgttaaaagctggatcggccaaatgggatcgaagtatattccgggccggatcgaggatgccaaactgttcggcatcatctggctcattcttgaaaaaggatgcatgaatgtaacgtggttcatggaattgctggaaaccacttccatccctgtcatcgaaccggcattgccggcatgggtggcgtcctgccttaaaaaagcaaaaacgatgaacgataacgggacaatcggtacacccccgcctgaggaaatcaatatggtcatcacccgtctgtttggaaacgccgctgtgcttgaaagcgaagagaaaaacaaattttccgcgcacaacctgcccgcacgctggtcagggcgctttattggtagaaaatcagatttacaagccatctatcactggcttctttccccttcgcctgtttgttccattacagggtgggccggcgtgggaaaaacgacgctcgcccttgaagccgcttatgcttgtgcaggggaaccgcgtgaagaagcggcaaatgtctctgataagtggcccgcgtttcactgcatcatttggttcagcacccatttaacagggttaagtttcaatgattttttaaatacaatcgcttaccagcttggactgacagaacaaatcgataaacccgtcatggaaaaacgttttgcagtgcggcatgctttacagctttttttccagggaacagccgatactgcttattgtggatagtatggacgccgctgaaaaagaggtgcttgaattcattatcaacctccctcaaggcgtaaaagcaatgctgacttcccgtgaaaactacaatcaagattataaagacgcttttcaaaatttcacaattgtcaagttaaagggattaaacgaaaaagaggcactttcatatttgtcatttgtcatccgcgaacatttgcaaaccggcagtgcacctaaccaggaagagttgcggcatctgacaccggagatgcaggcaaagctgatcaaagcggccgccgggaatccaaaagcgctgtccctctgtattgcctatatcagcgacggcggcattccggcagaacaactcattcaggaaatcgaaagcgccgggtattcattactggagttatttgaatttcttttcgggagaacatggaagcgcatcgatgaagcagcccgccgtttatggcaggtgctctgtttttttgaaaagccgcccgttgaagctgcctgggccgcagcggcaggattagatgccaggggcttttatgcagcagttgaacaaatgcggaattatgcgctgatccatcctgaccggacagacggaaaattgcgctaccccgcgcatcaaaccgtgattgcttacggtgaacagcacttgtcggaaaaccggcagctggaaaaagaggcgcgaaaacgatgggctcgctattatatccattttttggatacccatttaaaacgggaacagcccaatatattctattggcgctatctgcttggccgggatctcgatgatctgaagcaggaatggacaaacattcgcaaggtaatggaatgggccagccaatcagacgaaaaggaaatattgattgaattcgtagtccgtaccagccattttttaagccgggtcaatctgcctttacgggtcgaatacgggcgaaaagcagctgattttgctgctgcactgggaaaaagcatgctcgaagctttctttcggattgatacggttggatgggcgctgatggaaatgaatgagctgaaagaggcgctcacacaaattgatgccgggctaaagcggctatccggcctggatgctggcaatgaggatacccgcgacttgatggtctgggggcatgccttaaaatcaagggtgcttcttaaatcgggcgaccccgatcaggcagaggccattctcggcaaagtcattccggtcccctccaccccgatgatcaagcaccgtgttttattagtccagggcgatttatatttggaacggaaaaaatacaaagaggccatccgagcatacgaatccgcaaaccaaatcagccatgcttacggcggggaaaagacgattgaagcctattttaatctcggcatcgcatacgtggaaaatcagcagtttgaaaaagcggcggcggcatttgaaaagatgctttatcaaaaaaacaaggccaacccgattgagttaatgtactatcactacggcatggccagattatttgccaaaaaaggcgatttggcatacgccctttattccagtcaggaagcccttcatctcgctgcgtcatgggaacaaaacatcagcatccgcgatgaaacagaaaaattcaatcagtttataaagaaaaaaatccaatatcaaaacggatgaatggcgtcgatctaggtgcccgtgccataacgagccttgcatcagagaaaaatgacaaacagccggcgcaacttttcaagacagccgtcactgctgcaacgaaggcagcatcaacaaatgaatttcctgccgtgctttttttacgaaaaacacccggagcccaggaaatggaatctgcgaaaaaagaaacaggctgcatgttataatgaaccatggcatatataggaaaaaagcagaaaaaggaggggcctgccgtttggaggtggaatcatgcgcaaagcaggcgcccggattgactttttgaaaaaggagcacaaacatgttaaaagaagaaacacaacgaagcattacgcctgaatacgatccgtgggaagcatacatggacatcacgacgcacggcaaactgactttgtcgaatattgaattcacaacgaccactttatgcaatatgcgctgcgaacattgtgcggtcggttacacgctgcagccaaaagatccggatgcgctgccgcttgatctgctgctcaggcggctggatgaaatcagcacactgcgctgcatcagcattaccggcggcgagccgatgctgtcaaccaaatctgttgaaaattacgttctgccgctgttacaatatgcgcatgaaagagggattcgcacccaaatcaattccaacttaacaatgaaactcgaaaaatatgtgcaaattgcgccttatctcgatgtgctgcacatttcccacaactggggaactgtccgtgattatattgacggcgggtttgccaacatgcggatcaagccaagcgatcagcacggtgaaaaattgttcaggcgtatcgtggaaaacagccgcgccttgtcggagatgggcgtgatggtttctgcggaaacgatgttaaacaagcgcacattgccttatatggaacaaatccatcatcaaattgtcgaagaaatgaaatgtgcaaggcacgaaattcacccaatgtacccaagcgattttgctgctgatcttgaagtgctcagcttggatgaaattcgagaagccatccaccatttgctcgatatccgtgatgaaagcgtgtggatgctgtttggcacgctgccattttatccgtgcagccctaatccagaagaccaggccttattgaaaagattgtacgaaagcaaaaatgtgaccctccgcaatgatccggacggccgctcccgcctgaatgtcaatatttttacgggtgatgtgattgtcacggattttggcgatacaccaccgcttggcaatatccagcatgacaggctgcccgacgtctttgaaaaatggctcgaaacacccattgcaaaatcgctgaattgccattgcccgcaagtcaaatgtctcggaccgaacattttagtcaaaaatgcttactataaaaatattgattttacccaacgaaaagcagtcatcgacatgcagggcgcctcttccaggatgggctaaaaatggcagaagcatggggtgcgcctgccccatgctttctcgtaatctcaactacttttatcctgattattttcattctaatgcgttacaatacgcaacaaagatgattggatgtagcataaaatgacttttgatcaggagggaataaaattgggttggtttatcgggattatcattattatcttgctcgtgtattttttaatcatccgtcctttgatcgagcggaaccgcccgcaaatcattgaaccgcgaagaagcatttacaatggggatgcctatgacccgcacccggagcaaaccggatggaacgatgggggtaatgccggaatcggccggtttggcatgtttgccggcgggatggcaacaggtgcattgctgacgtatttactggaacagggcagaatcggtttagaccagttcgagcattttcaaaatcttgatggcaacgatctgttgcaagaactggaagagcaaaatattttacaacaggatgagattgaccatctccaggatactttaagcaactttgaagacaacggccatgacggtcatgacgacggaaatcatggagaccacgaccagcaagataccggttttgatttggctcatttcagttcccatgaggatcatgacgcacatgacaacgaccagcaagacgccggattcgatctggctgatttcagttccaatgatgacaatgactttggcggatgggatagcggatcggatgacaataactggctgtaagcatataaacagaacaggtgccgcaaccaaaagcagatgcaagttatgacttggtggaggctggctttaaaaaaatttacggaacaggtgctgcaactgcctgttccgtttccttatgacgggtttccagcaggctaacctgcattggcatttgccaaaggttttgcaagggctagaacttagaaatgagattggcagcgtagaactatttacaactttgtccaaaggttttgcaagggctagaacctaccgctccgggcaagacagatccatcgctgttccattgtttgcagcgacagtacccactcgaatcttggcgaaaaacatactagaagcacccggggattcggattccgtttttatcggccatcccgcgggtgctttgcttacaaggtttacggtttgtactttttttcgcttgaagaagtcgtttttttgtcatgatccgttttttcttcaagcttttcttctcgcaagtcttccattgggatcgggtcaactgtttgttcactcataaatttatcatgcatgtcttcgttttctgttgcaaattgttcggggttgtccattttccgttgcgatttctttttgttttcgttcatttcatatcacctcgtatggttcaataccctttatttttccgaaaaaaacagaaaatatccgacgaacatgcaaaaaataaaccgtgcctgtccaccccaaggggcagagattttgtgtttttctcgtattctctgttaattgttgcaattttttatgatatgataaggttgatgagaagaaagccgatggagatgattttatgtttaatcgtattcttgtggcaatagacggttcaaaaatgagtgaaaaagcactgaaatccgcactgaattttgcaaaagaaaggtttacaaaaatcggtgtcatccatgtggagaaaaatccggttattccggaggggatgccaaatgcgtcaatagataccctttattctgaacagcagagggacggggacgatttgctagaccaagccgccgctcttgctgaagaggaagaaattgagatagagaagttttatgaaacgggcgatcccgctgcccagattgtcagaaaggcggaagaaggaaactatcagcttatcattatgggaagcagaggactcggaaatctgaaggggctcatgcttggcagcgtcagccagaaagtcacccagctcgccaaatgtccggtactgattataaaatagtcctgtttcaaaagcctgtccagaaataccggacaggtttttgaaattgaaccgggcaagtgcctctctacatacaggccctttacgtaaacttattccccaacggtgcctacgtgaacttatggttggattttcgcattgttccttaacgtagaactgctctatgtgaacttatggccggatttttgcattgttccttaacgtagaaccactctatgtgaacttatgaccggatttttcgtccgttccttaacgtagaaccgctctatgtgaacttttgaccggattttttgtctgttccttaacgtagaaccgctctatgtgaacttctgaccagatttttcgtccgttccttaacgtagaaccgctctatgtgaacttttgaccggattttttgtctgttccttaacgtagaaccattctatgtgaacttttgaccgattttttcgtctgttccttaacgtagaaccgttctatgtgaacttttgaccgattttttcgtctgttccttaacgtagaaccactttacgtgaacttttgaccggattttttgtctgttccttaacgtagaaccattctatgtgaacttttgaccaattttttcgtctgttccttaacgtagaaccgttctatgtgaaattactatcaaaaatttcgattctttctcgttccccccttataaaacgatcaagctgggttatgttgcacaaactttcaagaattaccgcggaccctcacaaacccggacaaacatccaaaaagcctgccggaacccgtatatctaccgttaaaaagtatgtttcattgatttgcggagaatcagggagatttcaatttttttacaaatcgttaaatagtgcatcatcatgataagcaatgttcccgtattcatagcgatgatgacgccggccatttggtactggggatttgagccaagataataaatgaggcagtacgtaaccattgttgaccaaataaaatgcgcgagggcatccctgaccaggccgaggccgattaaaaacgcctgcatcggaatgacaaaatagtgaaacagaaaatacggccataacagacggacataaacggcggcggcagccgaatgggaaaacaaagttgtgagcggcacggaaaacacctgaatgacaatgacagccggaagcccgtaaagaaacgtcatcatcatcacctgctgaagcagtttctgcagctttatgccgtctcttttggcataagcttccgaaacagtcggaattaatacggtggacagggaatgggcaataaaggccggaaaaaatccgatcgtaaaagcgacgccggccaccagtccgaaatgttcgtttgccatcccctccgtcatcccggatttaagcaatacccatttgataaaaaatggttcaatcgcatttgtgacggcatgaaatacgcgcatgcccgttgtcgacaaggaaacagaaagaaggctccttctgatttcctttccccccattggagcctgttcttttttcttgagcgtccgcatttgcagcacaaacatatgaaaaagatacagcagcacaatcaagtcactaccgacaagtgtgcatatcgcgataaaaatcgacatttgcacgtcaaattccatccaatgaaatagcaagacaagcaggataagctgcatcatttttctcaggaagttggcagcagcaatcttccccatttgctgaacacccataaaataacctctcgcaattgaggaaaaggcgatcatcgggataagcgcaatgatcagccagcgaagatacgggtggtaatgatggaaaattggaagcaccggcagcaacaatgcaactgccgccatgagcaacaggacaaacaaagatgccagccggattgtaaacctcagcatatcacgatgatatttttcttcctgttccgcaacaaattttgaaatggagatgggcagttccatgctggcgatggtgacaattagaaaaatggccggcaaaatagacatgtatagccccatgccgtgcgccccgagttcatttgcaagtaccatattggttaaaaattcaatgcactctccgatgaaagcaacgccaatcagcataaatgcccctttaaaaaacactgccatgttcttcctcttctccttatcaagaaaaactttttcaataataaaggatatgaggcaagcctggagaatcattacaaataaattaacagagatgggagaggctcctgtgacagaagaaaacgtgattcgtcaaaaacaaatgctcgtaacaaaagaaagattagtgacagattttcgcaagcttgggctgaaagaaggtatggtggttatcgtccactcgtctttaagcgcgctcggctgggtttgcgggggagaggttgccgtcattctggctttaatggaagtggtgacagagcgtggcaccattgtgatgccggcccaaacagcgaataataccgaccccgccttttgggaaaacccgcccgttccggaagcatggtgggaagaaatccgccgctctatgcctgcattcgatcccgccgtcacgccgacttacggcatgggccgggttgccgagcttttccggacgtttccggaggttttaagaagccatcatccgacctgttcgtttactgcctggggacgggatgcaaaatcgattttgagcgggcactcgctcgacttcccgttcggggaaaagtccccgctcgcccggatttatgaccgggatggctgtattttgctgctcggcgtcgattaccaagtcaatacatccatgcatctcggcgaatccaggtccaagcatacaaaacggtgtacgcagagttgcgcgatgacgataaacggaaaaagggtctggcaatcctatgaagattacgaggaaaactccgatttattcaataaaattggccgcgcctttgaacgcagccatcaagtaaaaactggttttattggcgctgctccgtcaagacttatccaacagcgggcgctcgtcgactttaccgcgcaatatttggatgagttatacacggatacggaaaaagcgcaccactagttttctgatttccttttcgggtaggccccaacgtgcacaacagaccggcttgctgctattgatacgccagcatcgggttgccccaatctgcgcctagcacaacttcggcagcggccaattgatccatcagcgttaggtttgctgcctgccgctatcgatatatcagcttcgggcgacccaatctgcgctcagtacaacttcggcagcggccaattgatacaccagtgccaggttgctgctcgcggctatcgatacaccagcgtcgggcgacccaatctgcgcttagcacagcatccgcagtggccaattgatacatcagcgtcaggttgctgctcgccgctatcaatacgccagcatcgggttgatatatcttcattcacccgtttcctcggccgcttgtgatttcgcatgtacgcagtcgatttgcacagcacactcctttgcaattaagaacccgtaatcgtcccgccgtttacatgcagcacctgccctgttacatagctggaatcacgggatgcaagataaacataagtcggagccagttcgtacggctggccggcccgcttcattggcacatcacggccaaatttggcaacctgttccggatagaagcttgccggaatcagcggtgtccaaatcggccccggtgccaccgcattgacccggatgccctttctcaccagattttgcgacaaagcccgggtgaaagccacaattgccccttttgttgcagaataatcgatcagattttgatttccttcatacgccgttacagaactggtaaaaatgatcgagctgccggcttttaaatatggcaatgcggctttgaccaagtagaaaaaactgtgaatattgtttttaaaggtaaaatcccattgttcattcgtaatattcagcaagtccttctgcacaaactgcatggcgtgattgttcacaagcacatccagatgcccgaatgtatccaccgtttgcttcacaacgttttggcaatgctccggatcttttaagtcccccggaatcagcaggcaacgctgcccgagcgcttcaatcctccgctttgtccggacggcatcttctatttcataattggaataatacggaatcacgacatccgcgccttcttttgcaaacgcaatcgcggtagctgcgccgatcccgctgtccccgccggttacaatcgccactttattttcaagctttccagatcccttataggacgggtcttcaatcagcgggcgcgggtgcatcagtttttcaatccctggctgttccggctggtgctgcggcggaaaggcatatttttgcggatgattgcggtaacccggttccgtccgggaaaaatacatatctggcttctgccaatacaaatggaccacctctttatccaggctttttccattcagtgtattcgcctaaaagccggtgggtgacaattaatttccttcatttgccggcactttttccatcacaatctcttcgaaatgtttcacaagcgccagttccggatcgatggcaagcgggtcgtgccaagccagcctgagataggcttccgcgatccatttttgccgctgcccggccaatgcgtcttcgagggctgtgacactttcatatattttgaccatttgcctggctacttttttacaatggtacgtttgcgcggcttcctctttcgtctccatgacaaaacggcaagtttcttcgagttggtccagtccggcagatagccatgtaccggcctgcagctgatctattttctcccgcatcatgccgataaaaatgtcatgcactttaaatttccgcatcaggcggagcacttcaaggccgagaatattggcggtcccttcccagacagtaagcacctgggcatcacgcaaaagccttggcgttacaaagtcttcgatatagccgtttccgccgtgcatttcgatcgcttcatgggcaaaatggatggcctgctcggctgtttccattttcaaaatggcaatgagcagtcttgtcatgatgttttcttgttcatccgccttgccggaagccgtccggtcaaaaagtgtggcaagccggaacaccgcgcttgtttccacttcctgtttggctgccattttgacaagggtttcttttaccattggatagtctgcgagccggctgccaaacgccgtccgtctcagcgcataggcccgcgcttcccggtatgcccgacgcatgatgccgatcgaagcaatggcattgcagatgcgcgaaaggtttagggcctccatcatatagtaaaagcctttgcgcgggtcgccaaccaagtaagcttttgccccgtcaaataccacctcacccgaaggcaccgcgcacacgccgagtttatctttcaaacgccggatatagatgccgtttttctcgccgttttctttttcccacggcaccaaaaacaagcttagcccttttgttccggacggggccccttcacgccttgcaagcaccatagctaccccgcacatgcccacattagaggcaaaatatttttcgccgtaaagccggtaacagccgccttccgaaacggcttttgtttcattggcgccaacgtctgacccgccttggcgttccgttaaaaaagtggcaccttcatagcgctccgcttcacctgttgagattagctgcggcaaataggcttgtttcagttcatggctaccataatggtcaagcaaataggcggctgctgccgtcaatgtgaccggacaataaaacccgggttccgattgcgacagcaaataaccttgcgcaaacgcatacacataattgcctttttggcccaatgccggaatggatttatggacatatccaacaatgcctttgttatacacttgctccactgtttttaaataaccctcatttacacacactctcgatacatcttctccgtagcggttatatttgatcagcttgggctggccttcccggtccgtgtgggtcgcccgttcgtcaatttctccggcgcacatttccccgaattcggccagttccttttctgcccaatcaaaaaacagcggatccaaatattgtttcaaaagccgtgccaggttcggatcgtcatggtaaaagttcattggccatccccctcaatacttgtttttggatttttcccgtggcgttcctcggcagttcttctattctttcgtacaacttcggaattttataggatgccagtttcccttttagaaagcgtttgcattcttcttcaatattgtccatcggttctgccagcacgagaaaagctttgaccgtttccccccattccggatgcggaacaccgatcacagaaacttcccttattttcggatgggtaaccaatacgtcctcgatctctttcgggtatacgtttacaccgcctgagaggatcatatcttttttacggtccactacccagtagtacccttcctcatcttttctcgccatgtcgccagttaacagccagccattttgaaatacgcggttcgtttcttctggtttccggaaatatcctttcatgacgctttccccgtacaacgcaatttccccgacttcccccgccgctacgtcttcacctttttcattcacaagccggatttccatgccaagtgcagcgcgtttaccgatgcttccagctttttccgcgtgttcttcaggcagcagcaatgtcccgttcggccccgcttctgtcaggccatatacgcacacgagccggtccgaccgaaaagcattttgaatcaggcccacttccggtctggaaagcggcgcaccgccatatacccaatacttcatggtggataaatcgtaatcctgcaagttcggcagttttgccgtgaacaaataggccaccggggcaccgaagaaatgggtgattcgttctttttctacagtttccaccaatgcttccggtgtaaatacaggcgaaagcacatgtgtggcgcctacaaccgtgcctgcaaccaaaaagagatgaagaggcgctgaatggctgagcggcatcatgtgcaggattctgctttccggtttcattgccatttccacacacatcatccaggcggcggacaaaatattgcggttggtgaacaaaacaccctttggcttcccagttgtgcccgatgtgtaaagaatagaagcatcatcgtcttctttgagccggcaccggatctccgtttcaggcgaatggttaatcatttcttcaaaaatttgacagcctgtcacacgttcgcctgtttttatttttacgagatggggaggaaaagttgcttctttgagttcctcaaaaagcagctcatggacaaataacacgtttgctccgctatcgtccaacatatactccagttctgcgcggcttgatttggcattaaccggcacgacaataccgccaagccgcatcacggcaaaataggcaatgacaaacgcatttgtatttggcatcacgatgaccgccctgtctccctgcttgaagttacaattttggagggcatgcgccaaacggtttactctgacatttaattcctgataattcagccgttcacgaggcgaaaccaatgcttcctgctgtgggtactttcttgcattccgcgccaacagttcagaaatattcatccctgctcctcctttaagcgttttaaacgagtttcaaattctgccagatatttttccagttcggattgaagttcctggaggttttgaatttgctgtgcaacttcccggcgtttttgtttgccatactcgatcgttttttcgagttgttttatgccggagcggtcgcaatcgaacagttcgatcatttctttaatctcatccaaagaaaaatccagttgtttcccgcggaaaatgagctttaacctggtgtagtcctttttcgaatagcacctcctgccattttggcttctttttggcttgaacagcccaagctcttcataatagcggatggtcctcgtggataccccgaattcggctgccagttcagaaattttgcaggtcatacacccctctccttcccatttgcctctatcatacaatttacgttaacgtaaacttcaagatataaagcgtgaattccttttatcattatgaaacaattagaggggaatacgattatacaggaatgagccattttgggattgcatgtcatggatttggttgattatgccagcctatatttccctaaatgtattgaaaagttgccgaagcgaatgctaaggaataattggttggtttttgaaggaagtttttaaggaagtgaccagaggaagttcaaacaccgttcagaaaatggaattaaacaaaataaaaagcagcaacatacccgtattcttcataaggagtggaagtgggaatgataaaaacacctcttccatcctaataaatgtgtctccccctctacctgccctgtttttaacttaatgtaatataaaaaaccatagataagcaaaaaggagtaaataagcaatgatgtagaaaagaatattccctaagcttggttttttataaatattatacaaggacataaaaaacaggacgatgaatgcaccccagtacactggtgtacgctgaataaaagtaaccagtaaaccgacaactaaatatataacggatgaaaagcttctacgtgttgaggattgacccattgatatcaccaaacttttttaagtttttaaaaatactatttaaaaaacttcccggtactgaacgaagaatcgttttgaaaaaatttcaaaaaatatacagatcatcttcttaatagacaaattattccatatataaatccaatagtcaagacacaattaaaccttttagggtggataaaaatccgattaggatgacaaagaccttcgcctttagtgagagaagaagacctccccactgatttgattcactatattattgacaacactcggtgttttggaaccatgtcactcccctctacgttacagtaaacttcaagacacaaagcccgaaatatgtaaaccaattttatttttaggttgacatatatgccgcagttttttaatctattaatagataaaggaaaaaaggggagtgaaaaaatggcagcgaaaaaattccgtgccattgatctttgttatgcgggtatgtttgcggcgctgatggccattggggcaaatattacatccattgcgccgtttcttgttatcggcggggtgccgatcacattgcaaactttttttgccgtgctggcaggtttagtgctcggcagcaggcttggagcgatctcgatggtcgcctatatgctgatcggcttactgggagcaccggtttttgcgcagttcagcggcgggtttcaaaccgttttaagcccaacattcggatttattcttagctttatccccgcagcctgggcaacgggcaagattgtggaaaaacgccaaaacttgacaacgtactttattgcggcaatcattggcctgattttaaactatttgattgggaccaactggatgtacgccgcgtacaaaatatgggcgcaggccccacaagcgttcagctacaaaattgcctgggtgtggatggcggtgcccctgccaaaagacatcattttgtccttggttgcgggctggctggcacaccggattaaagccgtttccccgctaattgcgttaaaacggtagaatggccccgcttatactgccccgcccgatatggtgatttttcaggcgggacagtatttcggagcagggcatttccccgtttactgcgttaaaacgacgggatctttccaaatgcatacttcagacccccgcttgacgattaaatccgatcccgctgcagccgcctgaaacggtgcattcttcgggtgggacagtattccggagcagggcatttccccgtttactgcgttaaaacgacgggatctttccaaatgcatacttcagacccccgcttgatgattaaaacgaggcgggctatttattccactgtagccgcccgaaacggtgattctctagggaggacaatgctccggcgcaccgcttatcgcgttagaacgatgggggttccttttgttacaatgacggtatgttccacttgcgctacaaagcttccgtccggcgttacatacgtccagccgtcgcccgattctaccacttcatcagcgccggtcgagacaaacggttcaaacgcaatgaccatgccgtcctgtaacaaacctgtatcgtctgggtcatagtaatttaaaatatactcgggatcctcatgcagggccttcccgacaccgtggcccgtcaaattcaagagtacttcaaaaccattgtcgtacactgctttttcaaccgcccggccgatttgattctgccgattgccggcccggatttttttcaggccgctgtcaaacgccagctgcgcacattcgcacagcgcaaataattcgggatctccttttccgacaacaaaagagatgcctgtatccgcataatatccatccagcgatccggatacatccacattcacaagatccccttcttttaacacgcggtctcccggaatgccgtgcgccacttcttcatttacactgatacaggtgtaacccgggaagtcatactctccctttggcccggagaccgccccgttttctgcaaacctcttgcctgcccattcatccagctcttttgttgtgatgccgggcctggctttttccttcagctcatcgcgaatgctggcaacaagcctcccgatttttttcagtccttccaaatccgcttctgacttgacgatcatgttgaacgttcctttctgctttaaagtcatgactccattatatagaaataacgttagatatcaaaatccatggttcacccgaacaaaaaaggatgccgtgccccgcatgccggacgccgtcaaacttttcacacttttgtcgtatacgtaatgtttttgtaatattatttaatgtgagcgtaaccaaagaatcgacaaatattggtatagtgggattacaagattcatagacagaggtgggaaatttgaagaaagtagctccaatactgcttgcattcatgctgggaaccggttttttactgcctgctaaacaagcggctgctgcatcctattccccgtcaaaagtcatcagtacggcaaagaaatatatagggaccccgtacaggtggggcggcacaagcccatcaggttttgattgttccggctttgtaggttatacatttaaaaagaacggaaaaagcttgccgagaacagcagcaagcatttacaaaaaaggaaaaaaagtcagcaagtcaaatttaaaaccgggcgatctggttttcttccatacttattcaaaaggcgtttcacatgtcgccatttatatcggccataaccaagtcatccactccgtatcgcagggcgtaaagatcgacagcctgagcaatccttactggaaaccgcggtacgtcggggcaaaaagactttgagatcaaaaaacttcggaaactcccgatgttttttttgcactttttcctacctctaccccttccccggaaatctaaaccgggatacaaaaatatgaattaaaatttttccataaatcttattttttcctcccctatttaccataagaaacaaaaaatgctatgatcgtgctgcaagtctattaaaaatttacagatttaggaaggggttacagcatgaaaaaaatttggtttgcaacttttagccttgcccttgtgcttgcacttggcgcatgttccggaaattcagggcagtccggggcaaagaaaccggcaaaaagcagcacaaaaacagctttgatgaatttttatatgaatctcaccaatcatatcaatgcccaggacagggatttaaatacgtatgaacaggcgatcgctaagacggacgaaaaaccgccgaaaactgagcttgccaccatgcagaaggaagcgcagtcatccgcagaaaatgtagtgaaagaaattaaaaatacgaaaatcccatccaaaataagtagctatcaatcggagatcaaaacggctgtaaaagatttgcaacagtcctaccaaatgaaagcggatgagttgaaaaaaacgaacccttcgctggatgctgcgaacaaaaaactggaacaagccaacgatgaactcggcaaagtatttaaaaaagccggcttgtcaccggccagcctcccggacgatgttaattcataaggaagtttcaaaatataatcgggcgattgccgacccaaacggcttccgctgatgtccattcagagggaagtttcgaaatacaatcgggcgatggccaatgcccattcaaagggaagtttcaaaatacgaccgggcgattgctgatactcattcaaataaaagtctcaaaacacgaccaggcgatggccggtacctattcaaaaggaagtctcaatacacagctggacgattgcctatgcccaattaaaaggaagtccaaaacagaaggcctgccggagaatcgatttccggcaggccttctgcggcatgaaagacaacgaaactttgtatttcatctttttaaagcagaataatcttcccgcttttggaatccgcccagggaatgaagccatcctccggacaaatttttcgcattcaaaaaaactgatttgcctattcgggatctaccagctcaccgcgctttatgtcttttcgcctcaattccacatgctgcgcttttgcatattttttcaacaccgtttcttctttcggcgtgacaagagagacaactgtgccggggtttgaaccgagccggcctgtccgtcccgaacggtggacatatgcggaaccatcttccggcaaatcaaattgaatcacatgcgtaatcgccggaatgtccaggccgcgggcagcgacatccgttgccaaaaggagcgggacatcgccgttttggaacaaccggatacttttttctctttcttccttgcgcatatcgccatgcaattcggcgatggccagccctttgaaccggagtttttccactgcaaccgaaacatcccatttattattaaaaaacacgagtccccggacccccattcgggctatctttcgcaactgctcgattttgtcgcgcggatcgctgcttacgatataaatatgttcaaccgggctccgcgcctcctcttttgcaatgcgaatcaacaggggttctttcatctgttccatagccttatgggctgcagcatcaggcaaagtggctgaaaacaaaaggagctggcagtcacgcatggcggattttacaatttgtccgaccgtgcggctgtattcctttccgagcagctggtccccttcatcgagcaccatcattttcacttcatgcattttcagttttttctggtggatcaattcaaggatgcgtccaggcgtcccgataacaaggtgcgggtgttttttcagtttttcaatttgccgtttcacattcgcgccgccgatcagcgggatgctccggattccgcttccctgtgaccattttccggcttcctcttggatttgcatgaccagttctttagaaggcgccagaatgacagcttgaaccgtttgttttccggggtccatccggtcgagcacaggcagcaggtaggcgagtgtttttcccgatcctgtcggtgctgcagcaatcacatcccggccgtccagcacagcaggaatcactttttcctgtacagaagcaggatgttcaaacgttgaatttttccatgcctgttgtaaaaaaggctgtaaatgatgaatgaatgtaggttccattgttttttccctaaccttccttttccagttcttttatcatacactatcccgtatggaaaagaaaagttatctaacgtagacccgttctatgttaaggaagatcgcttaatatcgcccctatcttaacgtagaggcgttctatgttaaggaagaccgccaaaaatcgtccctatcttaacgtagaggtgttctatgttaaggaagaccgaaaaaaagtcatgctttcttaacgtagacccgctctatattaaggaagatcgaaaaaaatcgcccctttcttaacttagagccattctacgttaaggaagatcgcctaaaatcgtccctatcttaacgtagaggcgttctacgttaaggaagacccccaaaatgacacgcttccttaacgtagatccatcctacgttaaggaagatcgcctaaaatcgtccctatcttaacgtagacccgctctatattaaggaagatcgaaaaaaatcgcccctttcttaacgtagacccattctacgttaaggaagaccgaaaaaaagtcatgctttcttaacgtagacccgcttctatattaaggaagatcgaaaaaaatcgtccctttcttaacgtagagccattctacgttaaggaagaccgccagaaatcatccctatcttaacgtagatcctcgttccttaccttaaaaacccgtctaagtgaagtgatcgccaaaattctggctatttccttcacttagacgggctctatgttaacggatcaacaatttttaaattgcttctttttcatagacacgggctacatgagcgttttcgccaaaacctcttcggttcccttcacgtaaagtgcgcctcttccaaaatgaaagccattattttgcttcaacgccttcaaaagctttgcgtaaaatgtcttccaattcgctgacaagcggcaatttagggtttgcaggtgtgcattggtcttcaaatgcgcggtctgcaataatggcaacccgtttttcaaagtccgcccggttcacgccggctgcttttaggctaagcggaatattgaacagtttgcacatccggatgatttcctggcaaaggctttcgacaccttcttctgtcgtgcttgccggaagaccaagtacgcgcgcgatttccgcgtagcgttgatccgcaataaaatgttcgtatttcgggaatgccgcaaattttttcggcttttgcgcgttatagcggatgacatgcggcaacagaatcgcgttagcccggccgtgcggaatatggaattcagcgccgattttatgggcaagtgaatggttgatgccaaggaatgcattcgagaacgccatccctgccaaagtcgatgcattgtgcattttttcgcgtgccagtgcatcattgccatttgcgtatgctttcggcaagtattcgtgaacaagctggatggccttaattgccaggccgtccgtatagtcgttggccatgttggatacataggcttcaatcgcatgggtcaaaacgtccatcccggtatcggctgttacggatttcggaacggtcataacaaactgcgggtcaatgatcgcaacatccggtgtcagttcgtagtctgcgagcggatattttgtgttgttctttttatccgaaatgacggcgaaagaagtcacttcagaaccggtgcccgatgtggtcggaatgcagaccagctgcgctttttcacccagtttcgggaatttggcaacccgtttccggatgtccataaatttttgcttcaattcgttgaaatcaacttccggatgctcatagaacagccacatgccttttgcagcatccatcgccgacccgccgccaagcgcgataatgacatccggctggaagcttgccatagctgcggcacctttccgaaccgtttcaatagacggatccggttcgacttctgagaaaatttcacagtgcacatagtccgggcgtttccgcaagtaatacagtactttctcaacgaatccaagcctgaccatatccggatcggtgacaataaaggcacttgagatatccggcattttttccaggtattggaccgagttcttttcaaaatacacgcgcggtggaattttaaaccattgcatattgactctccgtttcgccattgtttttacattgtaaagattgatgacaccgacgtttgtggacaccgagttgccgccgaacgtgccgcagccgagtgtcaaagaaggcatataggcattgtaaatgtcgccgattgccccttgcgaagacggggagttgacaatgatccggccggctttcatttttaagccgtattgttcaatgacttcatcgtttgtcgaatggatcacagccgagtggccaagcccgccgaattcgagcatggcttctgcaaattcgaaaccttgttttgtgctgttggctttgtaacaggccaaaaccgggcttaatttttctctggaaagcgggtagtccgggccgacacctgtaagttcagcgattaaaattttggtatcttccggaacgtccacgcctgccattttcgcaatttcataggccggtttgccgacaatggcgctgttgacggattgcgtcttttcattgatgacggttttctcaacctttttcttctccgcttcattcaggaagtagcagtgatttgcaatcaattcgtttttcacattgtcataaatttctttgtcgatgatgacagcctgttccgacgcacagatcatgccgttgtcaaacgttttggacaaaatcaggtcattgacggcgcgtttgatatcagcagatttttcaatatagcaagggacgttccccggcccgacgccaagcgcaggtttcccgctcgaataggcggactttaccatgccggaaccgcccgtggcaagaatcagcgaaatacccgcatggttcatcaattgctgtgtcgcttcaatggccggtttttcgatccattggatgcagttttccggggcgccggctttcacagcagcgtcaagcatcacttttgcggcatgactgctgcatttttgtgcggacggatggaacgcgaaaataattgggttgcgtgttttaatggcaattaatgctttaaacatcgtggttgatgtcgggttcgttacaggagtgaccccggcaatcacgccgaccggttccgcaaatttaacaatcccttcattattgttttcgtcaatgatgccgactgttttgttatatttaatgttgtgatagatgtattctgttgcaaacaagttttttgtcattttgtcttcatatacgccgcgccctgtttcttccacggccattttggcgagcaccatatgctgttccaacccggcaagtgccatttgttttacgatattgtccacttgtgcctgatccagttccataaattcacgcagtgctttttgcccttttgcgacgagggaatcgaccatttccgtgatttgcgcagatttgccaacaactttttcatcgattgccatgttcgtggcccccattctaaatgtttttgtgaataatttcacatgatagactaaaaaatataatttgtgaagtatttcacatgattttctgccgttttacatttgtttcttttctttatggctttattataggcgatttcacatgctatggctgtgtcagattggtgacaaatgaataaatcatttataaacttttttctttaaaatattgctttccagccatgattcaattaaaataagttttttccgcctttttacattgtaagtgcttacattttatatttgaatatttatgcaaaattccgtatagaaattgccgtaaaaaaaccgcttctcgcttgtgaaacctgcacattcacaaggcagaaacggaaaaggagatgaattttatgcaaatccatctcccaggtgtgttagaaatatctttttttccaaaaaataagggctgtaacactggaaagaaccagagaggccaaaaacgccagccaaaacccatgggggcttgattgccatggcaggccgtgaagattcattccgaaaaagctggataccatcgttggcagggaaaggataatcgtgaccgtcgtcaaaaatttcatcacgccgttcacgttattggaaatgacagaagcataggcatccatcatgccgcttaaaatattgctgtgcacttcacacatttcgattgcctgtttgacttcaatcatgacgtcatccagtaagtccatgtcatcttcatatacttttagaaaatgctgccgtgtcattttttccatgacgattttattggcttttaatgaggtagtgaaatacacgagcgttttttcaaggctcaacagttcgaacagttcctcgtttcgcatcgattcgtgcaattcgcgttcgatcaagcttgatctgcggtcgatatattttaaatagttcaaataatagcttgcaacttcatacagaatttgaagggtaaatctggttttcatgtaggtgtaaaacccgcgcacccgtctgtgaataaattttccgataatcggattgtcctctaggcagaccgtgatgaaataaaaaggcgtgacaataatcccgagcggaatcgtatcatacagcgcggagtccacatcgtcctttaccttaaccggaaggccgacaatgattaaaatatcatcgtcttctttttcaatacgggagcgttcatcgacatccagcgggtctttaataaaatcgatcggtatattcgtttgttggacaacctggttgatttcttcttctgtcgggttcaccaggttcacccagcatccttttgacaaagtttctgtttccttcagtttgccgttttcgtccgttaaatacatatttaacatgcaggcacctcctcttctcttttgaggaagctcaagcatactttactcttccagagactgataacgtgtaggattggtcgaggccagtatgaagacttcctcttgcttatgtttcatgcacgacctcggatgcgcgtcagaatccatcagttatcatctcctttttttcttcgattcataaatagctgcgaaacctgcaaccattatattataccacaatatagtatgcctgaatatgtccgcttgttattttttagccggattatccgcgaaaaaaacttctataaaaataaaaaagcaatataatggcacaattgtgcatcatattgcttcgtgatgggacatgaggggctcgaacccacgacccgctgattaagagtcagctgctcttccaactgagctaatgtcccgcagatgacaatcattatattatcacaaatccgggaaagatgcaacgaaaaattttttagatctgggccgagaggatgattcgtcccggcccgattgattcttattttgcagctttttccggacatcgcacatttttagctaaaaatttcaatttgaggcgcctgtttactcggccccgataagtcataatgacgcgtgtcgattgaaccggtacttttactttatgccccatcgcgttcagcccgaatggcagctctcttgcgcccgaagagaaggctcgccgcgataaacccggcgcaggaaataaggaccggcagcaccactgtatgcaatccgaacgggtttggatgcaagcggtccagcagaatgtacgagcccatgccgagtatcatagaacaaaccgcgccgtacttgtttcctttattccagtacaagccgaaaatcaccggccatataaaaacggattccaggccgccaaaggaaaacaagttgagccatatgatcaatttcggcgggctgagcgacaacagcacgacaatgacggcaatcgctgcggtcacgctgaaacttgccgctttcatctgtttttcggatgcgttcggtttcacataattcaaataaaggtctttgacaagcgcggaaccgacgagaatgaggagcgcatcaacggtagacataattgcggccatcggagcagcaagcacgataccggccggcacaggcggcagcactttcatcgttaatagcggcattaccgtatcgggcactttcacacccggtatgacagcacgtgccatcacgccaataaaatgcatgccgaacataataaacccaatgacaatggtaccgatgatgatcgccctgtgcatcgcccgggaatctttgtaggacatcgcacggaccgtaatttgcggcaggccgacgacaccaatcccgaccaaaatccaaaacgacgacacataggcagggctcaggctgtgcccgtgtccgaacggcgtaatcagatccgggtcctctgcagcaagtttgtgcataatcggttccatcccgccgcccgctttaatggttgccaccagtaaaataagcgtgccgagaaacatgaccgtgccctggactgcatctgtcaccgccactgcgcgaaatcccccgactacgacaaacagcgtaacagaagcggcaaaaattaggagcgacgccgtatacgacaatccggtcagcgattcaacaaggcgcgcaccgccgatccactgtgccgtcatcgatgaaaacagaaaaataataatgcttgctgccgccaaaatgacgacggcatcactttgataacggctttttaaaaagtcaatcagcgtcaccgcctcatatttgcgtgccataatcgcaaattttttcccgagcaccatcaggacaaaatagccggttgaaagctgtgccatagaaagaagcacccagccaagcccctgtgtgtacgccacacccggcccgccgataaagctgctggcgctcccgtatgtcgccaccatcgtcatcgcgaggataaaaccgccgagctgccgttttccgagaaaatattcctgtacaaaagattgcgttttgatcacgtattgattggcccaaaaaccaacggcaaaaataatgagcaaaaaaatgagcagtggtgccaataccggccagttcatggcttatccccctcttcatcatcgaaagggatatccttaaaaaagaacttcacaatgaagatgacaagcgccgtcacgacaatatacccggcaatgcagctgtaaaaaaaccatgatggcatgccaaatatataatgatactgtttggccggccgtgaaccgaggccgtaagcaaaaccgtaccaccagagaaaattgaacagcacaagcccgacgccgatccttgcttctttgtgcgcctgtttaaatcttttgtcatctgttttcaaaatgtgccatcctttccttacttttgctactatcttacatctttttcatccggccgtgtgattttcaccatgaatcaggtttgttttgcataaaagcactggaacttgcaaaataagccgaacgaaactggattccttttcatggttgccagaaacaacctctcttctgatcgtcattgattttgacgcgaaaaacttcatttcattctatataagttgagcttaagttacatcaagcccgagcgccaatttgcacgatgacgattttttacagcaggcaacaaaagctgcgatattttagctggaacttcgggttgtatcccgatccccatcgcacagcccgataaaaaacgcctgcgttcgcatatttcgcgaaacaggcgtttttaccggcagacctgcaagtttcagatctgatggttttgaattctccattgcaaatcttccaaataccggagcaaatcatcgcgcagatcttcccgggaaagcgccatttcaatcgtcgatttgataaacccgaatttttcgccgacgtcgtagcgtttcccttcataagcataggcatacactttttggatttcattcaattgttcaatggcatcggtcagctggatttcaccgcctgatcccgtcttctgcaatgaaaggaaatcaaaaatctccggtgttaaaatataccgcccgataatggcgacatttgacggcgcttcctccactttcggcttttctacaaagcctttcacatcataaattcttcccttttgatcgagcgggtcaataatcccgtaacggtttgtttcctcacgcgcgacttccatgacggcaatcacgctggaatggacctgttcataaacatcgatcatttgtttcaggcaaggcggttcagcctgaataatatcatcaccgaggagcacggcaaacggttcattcccaataaatttgcgcgcacaccaaatcgcgtggcccagtcctttcggttccttttgccggatataatggatatccacttctgcaggctggcgcactttttcaagcagatcaaattttttctttgcgatcaaattgtcctcaagctcaaatgcgtggtcaaaatggtcttcaatcgcccgtttccctttcccggttacgatgatgatatcttcaatgccggaatcaatggcctcttccacaatatattggattgtcggcttatcgacaattggcagcatttctttcggcattgccttcgtcgccggcaggaaacgtgttccaagccccgctgccgggataatcgccttcttgattttttgcatcatttgtcacctctttataaaacggtcaccgtttcctaaacccggcgctttccctgcatcttttgcggccgtttccaattggtgcatcactttgggaagcagccgggaaaattcatgggcagtgagtgtagcggacccgttttcccggatccacaagtctgcgcatgccccgtgaatataaacggcattggcaaccgcttccttgatattagcatacgtgcatatatttgccaagagcatgccggttaatgtatcaccgcttccgccttttgccaggctgctgttgccggttgtatttacatagccgctgccatccggaaatgccattaccgtgtactgtccttttaaaacgacgatgaccccgtgttcctgtgcataagcggaagcaagcctgagcctgtccgatgcaatttgcccggtcggaatgcccgccatccttgaaaattcccccggatgcggcgttaaaacgaccggcgccgtacgtttcgggtatgcccttttatgtaatgccccggcatcgaggacaacaggaagtggttcttttaaaacgccgtgaatgaaagactccagctgctcatccggctcaatcccgggaccgatggccaccccggcaaatttctgccccaaatcgttaagccgctttgaaaaatccctttttaaataagtggcttccggaacgagtgtagcaatcacattccgggcaccgctttccgtaaaaacggagagtttcccgattcccatccgcatggcgccgatcgcagccagcgccgcactacccggcatatcgtcacttccggcaaccaaaagcccggtcccgaacgtgcctttatggacattgccgcttctttcggggagcgaacgaatgacatcttcctccgaccaaactttccattttgaagtatgcggcaggccgatcccgacagcctttgtttcgccgaaataagtggaagaagggaataacaggctggacggtttcaatccatgaagagaaaacgtataatctgcgtgtatggtatgtggatcggcatcacccgtatcccccgctacacccgtcggtacgtcaatggcggccacttttgccttccgagtattgatccaatcggttacttctgcaagatcatccctgagcggcagcctggtaccgacgccaagcagcccgtctgcgatccagtcataatgtttctcacggtcaaaaggggctgcttcaaagccgcacgattgaaaataggaaaaatgctgcgcggcctcttttgtttgcggtgggcctaaaggaaagatcaaatccgctttgtatccgttcagttttaaatagcgggcaagtacgatcccgtccccgccgttatttcctttgccggaaagcaccgcaatcgtgtcgcgtttggaaaggagcggtgcaagggcgcggtacagaccgcttccggcattttccatcagcgtaaacgtatccatgccgaaagaagctgcatttgcatcggcttccttaatttctttgcttgtataaatttgcatggccaaacacccccgttctcatagttttattgtaacactgcttgaatgcggcaacataaaatttctaatttccgaatcctttttttgtttttttcgtatttatagaagggaatgggtcttatagacgagaaagaaaggggtggtataaatgaaacgaactgctgaaattatactgagcgtcattggcgcggtgctaaacggacttgccgcaatcctcgttatcttctttacgatagccatgaaaagccaaagtattatcgatcagatgaaaagtgatgcctccatacgggaagccgactttcaaacagtccttcatacgatccaggcgctcggctggggaattgctgtggtgcttatcatcggaacggtgatcggcattgtcgccgctgttcaactgaggaataacaaaaggccgaagctgtcaggcattttgcttattatcgatgcattgcttgtgttctttttcaccgtcggattcggggtgctcccggcgctgctttacctgattgcaggcattttgagcctcgtgcgcaaaccgcccgtcatcgttgaatagagcatgaagccttcctgtacgagggaggcttttttgatgcaaaaaataaatccggccggtgcgattccgcttttcatgccaggaaatccggcaattaaaaaagccggatgaagattctccgtaaacgggatgcgggagcatggcgtttgtcggttgccgtttcaaaaatttagccgcatcatctttcccgccccttcctgcccgagccagaaacgatgcgtacttcaaaaaagtgtgataaaatcataataaatcgtttcaatattccgccattcaaaggaacctgcttcaacccgttctgtgaattcttaaaggagatgaaagagatggggttattgcataaaggtgtcacaatattggcttttgacgaaacgtatgatgaacaaaaaagggtccagtcttttccccatgaaactattaatctgaaacatatccgccataccaatcttttttgtgaaaagacggcgcttttccaaattgaaacggcactggaccgccgtaagcaaaaaggcatcacctttcttggaagcggcaattaccattatgtgacctccctgcttttaaaagaagcgccgaaaccgttcacccttgtgctgttcgacaaccatccggatatggacgacagctttgaacagacactgctatcatgtgggtcgtgggtatcctacgccttaaaaacgaacccgctgctgaaaagagttgtcatcatcggcccgacttctttcaaaacacatcgccgcccgccacaaaccgtccaaatttttccttttaacggccgggatcttgaaaaccggaaacgggttttatccgccattccaacagataccgtttatatcagcattgataaagacgtcctttccccggcttttgccgagacaaactgggatcaggggaggatgggcaagcaggaattgctgtcctgtatttcggccattctcgatcaaaaacaagtattcggcatcgatgtatgtggggaaaccgcagtctcgccggctgaacgctttctcccgcatgcgattgaaataagccaaaaaaacgacgccatgaatgctgaaatcctcgaagtttgcctggagcggcgcccgcaaccagcactgcacgtctgattctttttcttactttttaaaaaagaaagacttgatcttcctctgtaatcatgctttaatgtctattatacaaagacatttgttttctgtaaaaatacataaagaggtgtgatcaaatgaaatcggacgtttcaatcggactgcttggactcggaaccgttggctgcggcgttgtcaaactgatccggcagcatcaggaggaactcgtccatcagcttggacgtgaagtaaaggtgaaacgaattcttgtgcgcgacaccgaaaaggatcgcggtgtagacattgatcccgcctctgtcactacaaatcccgatgagatattaaatgacccggaaatcgatgtcgtcgttgaagtgatgggcggaattgatgaagcccgccggtacattgtcaaggcgattgaaaataaaaaacatgtcgtgaccgcgaacaaagatttaattgccctctacggcccggagcttcaggaactggcctggaaaaaccagtgtgacttgctgtatgaggcaagcgtcggcggcggcatcccgattatcagggggcttacagacggccttgtttccgaccggatccaaaaagtgatggggatcgtcaacgggacaaccaattttattttgaccaaaatgatggatgaaggcgtttcttatgacgaggcgctgaaagaggcacaggaacttggttttgccgaagctgacccgacatcagatgtggaaggcctggatgcggcaaggaaaatggcgattttggcaaggctcgcattctatacaaatgtgaaacttgaagatgtggaagtggaaggcattacccatctttcatccgcagatttgcattatgggaaaacgctcgggtatacgatgaagctgatcggcttggcggaatgccaggatgaacatattgaagtgagcgtgcagccggcgtttatcgcccaaaaccacccgcttgcttccgtgaaaaacgaattcaatgccgtttatattaacggggaagcaatcggcgaggcaatgttttacgggcccggcgccggaagcatgccgactgcgaccgcggtcgtgagcgattgtattgccgcgattaaaaacatgcagctcggcgtgaacggccggaacctcaggggcccgcgctttgaacggaaactcatgccgcctgagcagcgctacgggcaattttatatccgtatgcatttaaaagaccaggtcggcgcattttcaaaaattacagccgccttcagcgcgctcaatatcagctttaaacggattttgcagacgcctgataaacgcgatgagcttgcggaaatcatcattgttacccacaaagtgtcgctcgaccgtttccaaaaggcgctcgaacagttaaatgaaatgcctgttgtcaaagaagtgaacagctactaccgtgttgaaggagaggcataaaaacatgaatcaatggccaggattactcaaacagtacaaatcatttttacccgtcacagacaaaacaccggaactgacattatttgaaggcaatacgccgcttatcccgtttgcccgcctctcggaaaagctcggcgtggaattgtacggaaaatttgaaggtttgaacccaaccggctcttttaaagaccgcggcatggtgatggcggttgcgaaagcgatcgaaaacggcagcaggtccgttatctgcgcctccaccggcaacacttccgcttctgcggccgcctatgccgcaaaagccggaatccgggcaatcatcgtgatcccgagcggaaaaatcgcgcttggcaaactggcacaggccgttatgtacggcgctgaaatcgtggaaattgatggcaattttgaccaggcgcttaaaatcgtcaggaaagtaagcgaaacttcgcctgttacacttgtaaactcggttaacccttaccggctggaaggccaaaaaacggcagctttcgagatttgtgagcagctgggttcagcacccgatgtccttgccatcccggtcggcaatgccggaaacatcagcgcgtattggaaaggattcaaagagttcaatgagaaattcgaaaccggcctgccggaaatgcacggctttgaagcggaaggcgcagctgccatcgtccgggatcgggtgatcgaaaacccggaaacggtcgccaccgcgatccggatcggcaacccggcaagctggaaactggctgtcaacgcccgcgatgaatcaggcggcgtgattgactcagtgtcagacccggaaatccttgatgcgttccggctgctcgcccgcaatgaaggaacgttcgccgaaccgggttcatgtgcgtccatcgccggtgtcatcaagcaggtcaaaacgggacagatcaaaaaaggaagcaaagtggttgctgtcctgaccggaaacgggctaaaagacccgcagaccgccatgtcccaagtcgaagtccggcctgccgtgctgccggcaacggaggaagccgtgacagattatctttcgaatgtgatccatgtatgaacaggctggttatccgcgtccccgcaagcacggcaaatctcgggcccggatttgattcagtcggcatggcgctcaaccgttttttaacgcttgaagtgcttagcagcgaggaatgggtttttgaacaagtatcaccccttttgccgccgcttccggaagacagcgacccttttatcttaaaaattgcgcggcaggttgcggatttatacggcgtgcagcttgccccgtgcaaagtcattgttgacagcgaaattccgcttgctcgcgggcttggcagcagcgcctcagccgttgtggccggcattgaacttgccaactttgccggaaatctcaggctttcgcttgcagaaaagctggacattgccacccggatcgaggggcatccggataatgtcgcggcatccctgttcggcgggctcgttgtttcagccgagcaaggggacggacgagtcgaagtcgtgccgttttttgacattatggcggatttgctcctgtttattcccgattatgagttaaaaacggaagatgcgcgcaaagtgcttcctgatttttatgcacggaaagaggcggtaaaaggaagtgcggccagcaatctttttattgcggcgctcataagcggccagtacgaactggccggaaaaatgatggaacaggaccgttttcacgagccgtaccggacaaaattgatccccgaatttttggagatccgccggctggccaaatcactcggcgcgtacgggacggtcattagcggcgccggcccgacggttatttcgcttgtgccgtccgggcaggcagaggccatggcagaaacgatccacgcccattttccgcatgtgctggttgaaccggccaaaattgaccggaccggcctttccgtcgaaaaatatgcggcatccaatatgctgaacttataaaaaaggtttggagcatctccaaacctttttttatttccccaaaaatgaggcaagttctcttaacagttcatctttgtcttttttcaacgcatccgaagagagcatctcccatttccgcgggcgcggcaaatgcaccttcaattcgtggatgatggcggacggctgctgcgacatgacaaaaacacggtccgatagcagcacggcttcatcaagatcatgggtaaccataagaatcgtctggtttcctttctcccatgattcgagcagccagcggtggacatccattttagtaaaggcatcgagcttcccgaacggttcgtctagcagcataaccggtttttcgcataaatacgtgcgcaaaaagctgatccgctgccgcatgccgccagagagcgaggcgggatagtggccggcgtaatcctcaaggccaaactgccggagcacctccatcccccgcaaaacccgttcccgtttccgcaccccttttatttcaagcggcaaaacaatgttttgcagtgccgtccgccaaggcagaagcaaatcctgctgcggcatgaaaccggcggcatcctgaaccccatccggtttgccgtcaagcagcactttgccgccattcgccttttcaatcccggcaatgatatttaacagcgtgctttttccgcatccgctcggcccgataaaagtacagaattcacctttccggatcgttgcggaaatgccttccagcacttttttcccgccaaatgttttcgtaataccttccaattgcagatacgtcatggccggtttggaagaaattcgtttgtgtaggcagccttgatgttgatttttttcttaatgactttatggtcataaaggaagtccatataacggcgccacacttcttccttctgtaccccccattccgcggcatcgtcctggtacttcgtgcttagccacttctggctggcgcggacaagccctttatttgtatccggcacgtccttaatcaggatatcggcggcctgttccgggtgcttgatcgcaaatgtatagccttgagccgtagccttcataaaagatttgacaagaggtttatcccctttggccagtttttcgcttgtaatgatgaccgggctgtaataatcaagcgcagggtcgagatctttgaccatgataagattcagttttttcccgctccgctctgcctggatgccgtcccagccgtaataaatccattcaaaatccgcttcacgcccgattgatttgaaaaaatccgtctggccgagcacaatattttttactttgctgtagtcggcgccatatttttccatgaccgttttgatgacggcttcttcagacggcgaaccccagccgccgtaacgttttccttcaaagtctttcggagaagtgatgttgtcttttttcaaagaagcaaagccggaagtattgtgctggataatcgcggcaatggacacaatcggaattccttccgtccttgccgtggtgacattttcctgataactgaccccgaaatccgctttcccggaagccaccatttgttcagccgtaatattgtcccccggctggatgattttcacatccaggccctgcttttgaaaatagtgttttgttttagctacatacaggccggtatgattggtgttcggaaaccagtccagcacaaccgtcaccttttgcagcgcttttttgctgctttccttctgcccgcttccggcgcatccggcagcaagcagcaacatggccgcctgcaagatgattaacattttcttcattgatgatcttcctttcggtatacccatggtgcggatagcctttgcaaacattcaacagcgccgtataaaagaaatgtgagcccaatgatgacagcagagatagcaaacaggcgggccgtcataaaagatttcgtcgcccttgtcagcatgacgccgagcccttcgcttgcgccgagccactcaccgataatggcacccatcacactatatgtaacggcaatttttaaaccggaaaaaaagtaagggagcacagccggaaatttgactttccggtatagctgccattttgaagcatgcatggtctttaacagtttcaccaagtcatcatccaccgtttgaaacccttccaggatgctcaatgccagcgggaaaaagcagattaaaatgaccacaatgatttttgactggagcccgaatccgaaccagacgattaaaagcggcgcaattgccacaatcggaatcgtttgcgaaacgaccaaaagcggccggaccagcatccggaaaacgggaaccatatccataaaaacggcaatcgctgcgccaatcacaatggaaaaggctagtccgatcaatacttcttttgcagtttgccaaatattgggccaaaccatccattgcaggcttttcaattcctgccatacttccgtcggttttggcagcatccattcactgatatgaaagccggccgttaccccttgccagacgaagagcaaaaaaatgagccaggcagccgtgagcgccgtgttaacgaaccggctgcggcgtttgttcgcgatattttgcaattttttcatccattgtcaccccggtgcttggccggtaatggattttgatcgatgtgaggacatcaatcgcaccggcttgaacgcaagcatcctgcgcttttttgatgatctcaagcagctcgtcaagatcgccttccatcgtcgtttccattgccccgacttcataacgtacgccggcattttggacgacttcgatcgcgcggtcgacgacaccgtataagtcatcacttttaatatgcggaacaactgaaaaagaaaccgttacttgattcgatttttccatcaaattctcctcctttttttcaaataaaaaagctttcattgcatgcgcaagaaagcctgtccatccaaaacatgccgaaacatgcttcaatataagactccctacgctggcattatccagatcaggtgaagggtcgatgcaaagcggcatcctctcagccaaaccggctcccctgctttttttccttgtaattttattgtaacatgaaagccatcctttttggcaaaaaattttcaataggatggtgcggtgcgcaagccggcctttgcctgccttggtaaagattggggcgttaagatagcggggatttttgacggccttccttaacatagaacgcctctacgttaagatagcatgtctttttttcggacttccttaacatagagagttctacgttaagatagcggaactttttgccggcattcctcaacatagaacgcctctacattaagaaagcgggcatttttttcgagcttccttaacgtagaacgcctctacgttaaggaagcgggacttttgggcagccttccttaacataggacgtctctacattaagaaagcatgtctttttgtcgagcttcctttctatgttaagataaatcctgcttttttcacccttccttaacatagaacgccctacgttaagatagcggggatttttggtctccttccttaacgtagagtgactctacgttaaggtagcgaggatttttcgcggccttccttaacgtagagttccaacccgtgcgtaagtaacgccgcttattcatgctttaaaggcaagggtttccctgcatgccaacccaaagttccgactgttcgagcgcataagcgacatccagcagccaatgttcatttcctttcggcgcaaccagctgtacccctaaaggaagcccggccgctgttacatgaaccggcaggctgatcgccggctgcccggttaaattggccagctgcgtaaacggggaaaacgttaagctcggttcaaacatatcatagacaagtgcctgctgcttttctttcggaagtccggtaacgccaaacaagcgatcccgctctttcccggtttgggtaagttccccgattttcggtgccggaaacgcggttgaaggcgtgatatacaggtcataagtctcatggaaagcagccatttgtgctgcggctttatcccactccgcaaggctctttgcgtattccgccgccgtgacatttttcccggcagcatacaagacccacgaaaccggctccatatctttttccgtaagcgggcgtctaagtgcgctttccaaatccgaaagttccgccgccatttccccgcagttcattaaataatagttttccatcagccgcctgccgtcaacaccgtttttggcttcttccacaagatggccctcctgctccagccattttgccgttttatagacagcctgttttgcatcgcggctgacaggcgtcccgaccggcgattcaaccgaaaacgcgatccggtattttttcgttccactccgctctagttcctttacatatcccggaaaaagcggcgtttgaaaagcagcggcgggctctaccgtttgtagcacatcgaggagcgctgcactgtctctgactgtttttgccagcacaaagtcaatagccgccccttgccattgccgtccacggcccggcccgaccggtgtccttccccttgtcggctttaatcctgttaaacttgtaaaagaagctgggatgcggatcgatccgccgccgtcacttgcaccggcaaccggtaccatcccggaagccaccgcagccgcggaaccaccgcttgatccgccgggtgaaaaatggggattccacggattgcgcgccggaccataaagttcaggttccgtaatattttttaatccaaattccggtacgtttgtatgtccgagaatgataaaccccgcttccttcaattttgccgtaaaaaaagcatcttctctggcacggttttgctggagcagttttgatccggatgtgagcagctcgccctttactgcctgagaaaggtctttcagcaaaatcggcacgccggcaaatggctgctcatctgtacggagcgtggccgcttccttttttgctttctcaaaccgtgtccggatgacggcatttaaacgcctgtttgttttttcaatccgggccattgccgcctcaagcacttcttccacacttacttcttttcgctttacgagtccggccagccctgttgcatcatacgatagatatgcagattcttccatctctctccctccatttaattctatattgactgaattttatggagatgtcaaaacctatgaaactcgtttaaccctttttctaccgggtaaaaatgcactatcaccattaggaggcagatagagatggcaaaagaagtagttggtatttacacaacgttgcaggaaacgattgacgtagtagaccggttgaccgcacaaggctacagcacttccaatatttctattatttcaaacgggaatgatggaactttattgaaaaagcagaccggcgcaaatgtggaccacaccaccactgtccaggatgaacaaaacagctctgtctgggagaaaatcaaagggttcttcaagccggactattatgatgaaacgacaagaaaactgaccaatctggatctcccgcaggacgaactggaccgctattcgactgaaattgatgccggacactatcttgtgctcgtagacaatgatgcttctgccctcaatgaaacggccgctcccagaacagccgatcctgccacagaagtttccggccaaacaacggcatccgggttgaaaaacgaatttggcgaaaactactcaacgtcgcaagaaaaaaggtagatgttcgcgaaaaagtgctggatgtcgaaaaaaacccttgcatttaaaatttttgccaaagctgtcagtatccattttgcttattgagtaagccccaaataggccggccgctaagtttaaaagggcaaacccgcacggaaaaggcgggtttgccctttttctttacgttgatgaggaaggatcaggcgtaacaggcagaatcgttttagcgatcgactggtcgagcgcttcaaattcctctaaagaaatcgtgctgtaaagctcttttctcgtctgcatgtcggaaagggcatttttttgcgtgccttcgtttttgattttttcaaacaccctttcataagcttttgcggcaacgcgcagcgaagtaaccggataaatgaccatcgcgtatcccatttcctgaaattcttccgccgtataatacggggttttaccgaattcggtcatattggcaaggagcggcgcttttatttttttcgcaaacagccggaattcatcacgggactcgagcgcttccggaaaaatcgcatccgcccccgcttccacatacgcctcagctcgcgtcaaggcggaatccagcccttcgacgcctcttgcgtccgtacgtgcgacaactacgaggtgcggtgccacacttttgagcgcccggattttttcgcgcatgtcggatgtctccacaagctgtttgccgtttaaatgcccgcattttttcggaagctgctggtcttcaatctgaacagccgcaacccctgcttcaaccatttcgcgggcggtgcgggcaacgttcagcacgccgccaaagccggtgtcaatgtcaacaagaaccggtaaatcggtggcacgcacgagatcgcgtgcacgttccgccatttccgtcaatgtgatcatgccaagatccggaatccctttgctcgcggtataggcagcgcctgataaataaagcgcctcaaaccctgtgttttttgcaatgagtgccgccattgcatcatgcgcgccggggatttgcaaaatgcctggcgcctgtatgcgttccttaaaccgtttggcaagcgcctcctgtgaagacgggtgattgacaatccaaaccatggtgcaacatcctttctacaaggtgaataaattgacgaattcatgaacggccattttttcaagcgcttctcccgcaaggcaggcttctttgatcctttcctgctgcttcgcggaatagtgggtggcgatattatccgaaaacttggtgataattttcgggatcgcttcttcccttctgaagcggtggccaagcggatactcgacttccacattttcagttgatgtgccgtcttcaaaaaagacttgtacggcattcgcgatggaacgtttatccggatcaaggtaatcgatgctgtattgtttgttttcaacaactgccattttttccctcaatgcatcaatgcgcgggtcagcggcgactgcgtcttcataatcgtccgccgtaatattgcctttgatcaggccgacagccgtcacatactggatgcaatggtcgcggtcagcagggttataaagcggcccttttttatcaatgatgcggatggcagattcatgcgttgtaatggtaatatgcttgatttgatccagtttcccggcgacaaccggatggagtttaactgcggcttctgctgccgtctgtgcatggaattctgccggatacgatactttaaataaaacattttccatcacataggaaccgagcgggcgggccagtttcagttctttccctttgaacatcacgtcctggaatccccacccgggtgcggaaagcggcgtttgataacccatctcccctttcatcgcaatcagcgcaagcgccacgcccctgctggttgcatcgccggccgcccatgatttgcgcgaaccggtattcggcgcatgccggtatgtgcgcaacgggccgttatcaatccaggcgtgggaaacggcgttcatgatttcgtttttcccgccgccgagcatttttgtcgcaacagcagctgtagccactttgacaaataaaacatggtcaagcccgacgcggttcaaactgttttccaaagcaagcacaccttggatttcatgggctttgatcatgccctcgagcacatcgcgcacttttagcggtgctttcccgttggcaacgcgcgtccggctcaaaaaatccgcaacagcaaggatgccgccgaggttgtcggaagggtgcccccactccgccgcgagccacgtatcgttataatcgagccagcggatcatgcagccaatattaaacgcccccgcaaccggatcgagcacataggaagtgcccggcacatgcgtcccgttcggcacggttgtacccggaacgatcggaccgagcatttttgcacactccggaaaacggagggcgagaatgccgcagccgagcgtatccaaaagcccgtaacgcgcagtctcaaaagcttcggaactcgtaatctctttgtctagcacataacgggcaatttcttctatcagggcatcccgctcccctgttttttcatttacagctgttgtaccggccaatttaaacattcccctttccaaacttcatctgcagtgcaacaccgggtccttaagacagcgttttaccccagctttttgttcactttatctcttaatggtcccgcctttttaaaacctcatcttgcgaatgcaagccatccggtcgcaggcctttttaaaacttaatcttgcggatgcaaaccgcgcgggcctttgtattggacgcgcggacggaacaggcggttgttttcatgctgctccatcacatgtgcgcacagcccgaccgttcttgaactgaaaaagatcggcgtataaagcggaatcggaatgccgagcatccaataaaccggggctgcataataatcgaggttcggatagagccctttttcctgcgccatgattttttccccggcttcgcacatttcaagcagcgaatgatcccctttttccgcacaaagttctttcagcgcttctttcatcatcaaagcgcgcgggtccatctttttcatgtagacgcggtggccgaaccccattactttttctttgtttttcagtttcgtataaagcatttcttcaaatttttccaccgtgccggcttctttcagcatctccatcaccgcttcattggcgcccccgtgcagatggcccttgagcgatgccactgcgcctgttaacgccccgtataaatcggacaaggtggacgcaatgacccttgccgtaaaagtcgaattcggcagttcatgttcgctgtacaggacaagggaacggtcgaaaatcttttcttccttttccgaagggactttcccggtgatcatgtacaggaaattggcgctgtacgacaaatcctgccgcggttcaaccgggtcctcgccatttaaaagatggtagctgtttgcgacaatgttcggcacattcccgagcaaatggtatgcacggtttaaattggctttacgggagcggtccagcaggttttcatcataccccgccagcgctgaaacccctgtacggagcgcatccatcgggtgggtggatgccggcaatagcttcaaaatgtccagcacggcgtctggaatccggtagtttttctttaaactttcttccaacgcttttttctcggcatcattcgggagcgtgccttcaagaagcaaatgcacgatgtccagatagcttttcgttttcgacaactcaatcaagtcatacccctttaaaacgatctcgccttgggccgtgtcaagaaaagaaagctccgtttcaacagcgacaaccccttcaagccccggcacaaactgtgtcgtatttcccatctccattcatcctccgtttctgtattttgtcaaaactgtaagcacttacagttttatgtaaaacaaagttgccaatacccctgatgctttcataaaaaacatatcataatatttacaaaatgacaacgcccacaggctttggacgacgattcagaacggtcctgtgatccggcttttcaaacagcccggcttcagggaaactttccgtgctcttcctgccatttccccggaacagccaacaaaaaaagacaagtttaacctgccttgtcttttaaaactattgctttttcggttttctcttaaaactgcgcttcacaacatcgaagaaactcagtgactgaaccatccgattcggatccacatattggcggaccgcccgcaacacccttttcggatctttggaagaaaaggtgtatgtcccgtttttcttcgttttgatcgcataacgcgggatccattttcctttaaacatgacggaagcgatcacgtaatcgacttcttcccaaggaatttgaatgtatttgcgcacatcgcgctcattgaaaaattcaaatcctttatcgccgatcatgattttgccgtaatctgtcaatcccatatgcgcggctgcctttatcaccaaatccacttttgtattgattgattggaccatttgatccaccccgttcttttctttttgtggtttcaaaaattcatatctatacagcttatcttgatttccggatcttcgcttctaaaaagggtcctggttgaccggtgaaacggctgtacatcgcaattcttcccgcaaccgtatttgtaaatccggggcaaatcttccccggctggcctctcccttattatacgaagttttaccgcctgaagcaaaacatactcagaacccgtatacaacccaggggctggcggttttttttgaaaaaagcccaggccagaaagcccgggcatttgccttttcttacattaagtgaattaaatggaatacgataccaacaacaaacaatccaagaatcataacgatcggagacactttctttttcaaaagccacatgcagaacagcgtcaaaagcaatgcggcaaggcccggaattaagctgtccaggttgttttgcaatgtcgtgactttgaccggttccaatgagaggccggcagcttgctgttcaagcgccgttttaatcccctgtgctccggcaggcaaatgattccagtcaatataagcgcctttagaaagttttacttgtgatacaactggtgtaaacttaatcgatacccatctgttaaccagcgcgccaaggataaacatcccaaggatcgatgcgccttttgtaatatcctgaagaatgccgcccgataagtcctccgtaattcttgaaccagctctgtagccgaattcttgtgtataccacaggaatcccatccggatgaggttccatgcaacgaagaaaataattggcccgagaatgttgccgttcaatgccagagaagcacctaacgcaccaaggattggcctgaccgtgaaccagaataccggatccccgatccctgccaaaggccccatcatcccgactttcacaccttgaatggctgtgtcgtcaacgggagcgccgtttgcacgttcttcttcaagcgctaaagttacaccaacaatcggtgcagcgacataagggtgagtgttaaaaaattccaagtggcgctgcagggcagcagaacggtcttctttcgttttatataattttttgatggccggaatcatggtatatgcccagccgccgttttgcatccgttcatagttccaggaaccttgaaggaaagttgaacgccaccatacagaaatacgatcttttctagataattttagttcttgtgccatttttctgtccgcctccttcttagtaattgtcaataatatcgcctaacggatcgccggtgtttgcatttccgccgcctttaccggagccgccttgtttggagagcgccaaataaatcagtgcaagtgacacaccgataccgccaaggccgataagggtaatttgcgaaacagttgccaaaacgaacccaatggcgaagaacggccatacttctcttgtcgccatcatattaatgaccattgcataaccaacagcaacgaccattcccccgccgattgcaaggccgtctgtcaaccaggtcggcatggcggataacaagtcacgcaccggtcctgcaccaatggctaaaaccaggactgccggaatcgcaatacgcagcccttgcaggcaaatcgcaacaatatgccaaaactcaactgttctgatgtttccttcccgcgctgcggcatccattaagtggacaatccctgttgcaatggtacgaacgatgatcgtcaataagaggccggcaaccgcaagcggaacggcaatcgcgattgcagaagatacaccggctttgcctgcgccgcttaaaactaagataatggcagatgcaacggatgcaagcgcagcatccggcgctacggcagccccgatgtttgcccagcctaaagcgatcatttgcagggtaccgcctaagataatacatggcaccaagttacctgtaacgaggccaattaacgtacaagcaacgagtggctgatggaactggaattggtccaaaatcccttccataccagctaaaaatgctacgataaagactagtatcatttggacaatatttaaatccataacgagtcgtcctcccttttctcctgatgggcaggattatttttgtttgttcagctcttcctgagcccttttgagaatttcgtccatgtcgccttttgcatcgcccggaactttgcgcacatcaaactttagccccagttctttcatttttttgaaagcatcaatatcattctggctaaatgccagcaccttgtttggctgaactttgcccggcgagtgtgccatggaaccgacgttgattgttttcaatggaacgccgccctcgactgcacggagcacatcctgcgggttttcaaaaagaagcagggcgcgctggccaccgaaatgctggtcatctttcgcaagttcaatcattttacggataggaacaacgtgtgcctttacaccagggggcgcagcctgttgaatcagtttcttccgaagttcgtccttcgctaccgcatccgatacaacgatgatacgtgtaggccgtgtcgtttttgtccaagatgttgcgacttgtccgtggagcaggcgagagtcgatccgtgccagcacgtattcaaacttgccaggagcccctgccgttaacggttttccggcaggcttggaaggtgcggccggctgtaatgcttcaggccttactttcacgccttctttcgctgcgcctaaaatatgcgcggcaatgtcctgggctttgttcatcgtggcgcgtgctgcaaatgcttcaatgagcattggcaagttcatgcctgagacgatggcccacttgtctttgtgttcttcaaacaagctgttggcctggttgaaaggtgttccgccccaaagatcgactaagaagaggacttcatcctggttgtcgaaagaggcgactgcttctttcatttttgcctttacgttatcagggccttcgctcggcatcaatgtaacagcttttacattttcctgctttccgaagatcatctctccggattgcaagacaccattggcgaaatcgccgtgactggcaatgataattcctaccatcttcttacctccctaatcgtattgttacagtatcaatcttataaataagttctaaagaacctgtaactaaattcatggatgtagccgtttttcctttttgatcagctgcatcaaatcgattttccggtcggcgggcacttggcggatttccaattcgatgccgcgtgcagccagcttcgcaaaggcctggatatcatcctcattgactgaaataaaattggtgatcatcttcttgccttccgtaaaacgcatgccgccgatattgaccgatttcaaaccaacccctgcctggacaacttccagtacatcctgcggcgaaacaaacagcagcatcactttcatttcgtcaaacagccggttttggtaaagttcaagcagtttttgcttcgtaatgacatgtgatttgatgctcggtggtgtcgcttgcttcaataaaagctttcgcagctcgtcattggcggcttcatcattggccactaaaatccggtcaatccccactgccctcgaccaaaccgtggcaacctggccatgaatcaaacgatcatcaatgcgcgcaagccgtatatccaatgccatccgaccacctcctgctaatcaatcgtaaaaaacttgcctttccgcctattataatgcaagatgtgtgccaacttttgagtatcaaaaaacaaccgttgtcaaataagcgttttcagaaatccttttatgcttatgatacacaaaccgtttgtttaatacacattgaaaaagggttttattttccatttcgctactgtattaaaaagttctgcaatacctgtatcattttgatacttttgacctgcatgtgcattccgtatcagggatatctctccgtctttttccccggcataaaaaaagcctgcaaatagtgagaatctatttgcaggtaaaaattaccgcacggctgcagtttgctcggcagataaatggtcgatcatgtcggcaatataataaagttcatcatccgacagcttcaatttcagctggtcttcaaaaatttgcgccgcctttttatattttttgattttagcagttttttccggcgtgatgtcatttttgtaaatgaggccagactgggtgaccattctttcgagcgcacaaccgatatgaatattcatattgattttcgatgcgttgttaaacggcctttccgctattttttcaagggcagtgacaaacgccgtaatcgctgtgatcactttctttggatttaaaaaggttaaaaattcattcaggctttcttccgtcatttcccgcaccattgccggagaccttggcggttgtttcagcaactggtggttttgaatgagatgggtgacctgcgtttccccgtcgcccataaacaaagattcaagcggaacaaacggtgcctggactttcggatcggcaatcccgacagcgagcaaaatgtcatatttctgcatcagcatttctttcttttcttctacttcgttgattggcagcgggataacggcaatattggttttgccgatgtttttgagcagtcttgtaatcagctgctttaatttttccgccgtcccttcccctgttgaacagacggaaagaatggcctgcggtttcacgggcttccctgtttcccgcggtttgctttccatctggtaagatccgtagccgcggaattcctttaatgactcataaatatcgtcgagatccatttccataatcgtcgctttgcggatcgcttcaatgacgagcgccgttgtcaccatatcgatggtccgcgttttgatgcccgtttcctgtgtaatcacatcgccaaacccggtcagcgagcccatatcgacaagcagcaggacgccttttcccatatcaatttcttttacccgcctcttcatttcctccaaaacatatttcgggtccatatcaagcggcatatcaatgcagtccacattcgattcaccgaggaggcttttcacaacacttaccatgctgcttgcggtgctgaacccgtgcgcggcaacgaggatcgccacctgctcggccttttgttcgtctataagagatgtgagcaaaatcgttaagtacatggcttcttttaccggtacatgcacgcggtatttttccccgatcattttgcaaatatcaagtgacagctgatactcctgcggtcggtcattgatgacattttcgatattcgtataattggccacctgctggttttttacccgcttcaggaaggaagtcaagtgcaggctgaacgccagcaaaaaacgttcatttactttgcacttcagccgtttttccacaatatcctgcacttcttcgctgaaattaaggatatcttcgctgacaatttttaagattttctcacggttcagcgcatagcttgaaaacttgttgtaaaacttgtttaaatggatatcgatgtccaatttcagaaaccggttaatgtcttcatccgacacgtcctgttccatcataaaactgactttgtcctcgatgatgttgtacaggttaaaatccggttcgtacgggtcttcttcaaagagcgccttgttttccccttccggataaaccgttaaataggaatcaattaaatcggaaagctcctggatttcctggcgttttctactaaaatagaagaaaccgtttttcagttcggatggcagatctttaaagtggatggtaatgacatcatcgtgcaggcagtgcagaaaaccgttggcgcagacaagctggatgttggatttcaactgcccgacgttaccgtatgacgtattgccaattaacgccttcatcgattccgcatcaattttaatcggtttttggacgcggtttgcttcaatggcaagcaggaatttcagaatctcaatcttgtcaattgccggccgttcttcaaaagacggaatccggatcaggatcggaatacggcggacaaacgttttcaacaaggaagattccgggtcttccgttgtcgccccgacgatcaggacattggcgttgcgattccgttcggtttccccaagctttgcatacgtccccgtatccataaagtaaaagagcatttcctgtccttcaggcgggagccggtggatttcatcgagaaacagcatgccgccgtccgctttggaaacaaggccgtctttttcgctgtccgcacccgtaaaggcgcctttaatatgaccgaaaatgtgggaaatgaggagctgcgggttattcgcataatccgcgcagttaaagacaataaattgggcgtcttcgtccataaacggggctgccagttttgcataattgaacatcaaattggcaaacagcgttttcccgacaccagtctggccgacaatgagcgtatgaaggccgtgcgggggatagaggacggccgcctttgcctgttcgacctgcactttcaggcttgttttcgaaccgatcaggtcatcaaagggattcgtttcccaggcggtatcatgatttgcggacggaccgttgcccggatccggggattgcccgcccgtcacttcaagtatattttcatattcatattgatcttccggcaatttcgttccgagaaggtcttccatgatttgtttgaccaagtaatgaaccgggcggccttttattttgataatccgtttctgccgcaacagcttgttcagctcggcactgacattgtttcttaaaatgccaaggtcttttgcgatatccgaagctgtaaatccttctatacggatccattcatcaagcgttttgccttgcgactgttcaacaagatacgcgtaaatgcggtcaatccttttcaaaatgccaccccatttctaagtataaactgtatcttaatagtatcacgaatgtatcatccatcatagcaggaatatattgcgaacaagtgtcaagtttttgccaaaaggagcttatctttaatacacttttagaacccacgctgcttcaggtgaaaacgcccggtacacccgaaaaataggataaaaaaacaacgccgcatatgggcgctgttcattcaacaattttcggccgcttccatccatctgctttccgcaacatccggccggttcattttctgttcccaaaccggttcatgcatgtgtttccggcgaaattcaggcggttcatttattgatcatattggggcttactgaatccgcactttcgccatgcgttcagcaagccctgtttccccttaagccctgtgcctgccccgtcatcgtcttgcgaaaagtttacactttcccgcttgttttctgtccgagctgcatccattcaaactggcggagtttcagttcgaataatttcagcggatcctgatacacttccggattttctttcatattctccagcatctcttttgtctcggcaatggccgcccctgtttccgcaatcgtttcgcggagaaccgtttccggatttttaaagaacaggcggacatcgcgctcaagcccttgttcaaacagctcgaattgcagcatcactttattcgtgacaaggtttgcaatttccgtataatcttcgctttcgataaattttttatagcggttatacagcattgttttgttttgcgaaagcacaccaaacaatttgcccgcgctctttaacaggacctgctgcggcgtatggcgcaacaatatattgaccggttcaaaaggaattccgtttgccatccgatccgcatcacgccgccagtcctccataattttaaaatcgcaggcaagcgcaagaatctcttccccgtacaacttgttaaacccttccgccatttcatcaagataatcctggctttgctgcaattccctttccgacgcttctatccactccgtcaccagctcctcgtatttcggggaaatggacgtctgcaaaaagtgccggatccggttgttcatttcttcattcaactcgagatgaattttccgaaaatcactgtccggcttaataaaatcggcgcttttccgtaaaatttccggaatcttattttgcagttcatcgcggattttccgcgtcatgctgtgataggacgagcggacaagctcggtttgttcatggatgacatcctgaagctggtttgccgctccgtttaattttgcgtacagatcttcatgccggttgattgactctaccagatgctgttcattttgcagcctttgtttcagcagatcggcaatcgattcccgaatgcagtgcgatagtttttcaatccggctttcttccaggttttccggcttgaaattttgccggaaaaagcgggcaagatccagccctgcttctcgggatgcataattggacgtataagggtgcaagtttgcctctggaaaaatcgttttcaccttttgtactgtttcttccactaaatctgccgcttcctgcttgctgtatatcatatccattttggacagcaaaaagtgaatcgttaacccgggcacttgttccttcattttcaacaacatatccgcttctttgtctgtaaggggatcatttgcatttaaaacgaataaaacgccgtcaacaaaacgcaaatactcgtatgcctttccccgccccggcccgttcagcccgggtgtatcgatgaaaataagcgcattttcttccaaaaaccggctcggaccccgccattcaagcatgtctccgggctccggcgccgcattgtcctcttccgttacaggcgaaatgcctttgtccgagatcacagaaagcgcatgttcatcatcatggcgcaccgccatcacaaactgtgtcggccgttcggggagcgggtcggccagcaccgactggataaaggccgtcttgccgctgccgttcatgccggtaacgagaatgtgctggacatcaaagtcaatcagctccctcgccatccatttcaaacgggtgctgacggatagcccgttcctttttgcccattgcataatggaatcaaagagccggagcgcatattcaagctgatccaatgtttgctccgcatgattcagaatcgtttccgcatcggcaatttgctgcggcccgatgctgcccggaaaaagatcgccccatgcgagaaccgcagtggatgcttgaagggcgtgcgcctggtccgtgatccgcagccagttcgttaaaatgcccggcatcaccggtgccagttgttttaacagatagctgccgctgattaaagaaaaataggtttccccgtaaatggcagacagctcgtgccaagtttcaagcgaatggagttcaagcccggcaaataggtcattgaattcgcggagccagccgagatacgcgccctccgtttcgtaggaccgccaaagcgcaaccgccagttgttcaaactgaatttgatccaccttgtataaaacggacagcgcatcccgaaaataatccggcgcaatcgtcttggtatgccctttttcaatatacgactttaaaatttgaaaccaaaacagcgattcagtgcggatggattcattgacagccagttcaaccgcattcatccagtcttcgtttttttcaaagtaggcacgggcgattttcgtcacattcggatagtccgggttcatagcgaccgcttgtttgattgtctggacagcctggtcatgcttttgctcctccatataaagtgagatgagctgaagcgcgatctccgtctttaacacgatagagtctgtttgaaccgacttgtaaatttcttcggccatgctgctgagaccgagttcaaaataagcatcccccatgtttttttgcgcccacggttcaaagtcgttatgtatgctttcccatttaaaaacggccgcttcataatctttataatgaaaataaatttccccttgtgcaaagcggatataggaaagatcggcattttcaagggcattttctttttcgagcgcttcaccgagcacttcaagcggatggcgctcttccccttctttgataaacgtttcataataacatttttggacaaactggtcttccggcttcatgattttcctcctcacacggccttttatatctctatcatattgcatccgggatgcagcgatgtgtagaattttgtcgattactttattttatcaaaacatctccaacaaaaaatttcagttcgctttcaattttgatacaaaaatgaaacatttaccatattttcgcttgcttggagcaattttgagcatgtttcccgtttatcaccctgtttttcgctcatgacatcgtacccggaaatgcgcctgaatgaacgggaaacgttttctatgttataatattcacattacagattggaaggagcatcagccatgggaaaaacaaaatggacagggtatgccggcacctatacaaaaggcgccagcgaagggatttacaccttcaccctcaatacagaaaaaaagcaaattgaagatgtgaaagttgccgccaaactggacaatccgacttatctcaatatcacggcagacaaccgcaatctgtatgccgttgtcaaagaaggcagccagggcggggttgcggctttttcaattgatgcggaaagcggtgctctaacggaattgaaccgccaattatccggcggcgcctccccatgccatgtcagcgtggattcggcaaagaaaacggtcgtctccgccaactaccataacgggacggtcagcgcctatctgacaaacgaagacggcagcctgcagccggcagcaagtgtcatcgaacataccggctccggcccgaacccggaacgccaggaaaaaccgcacgtccattttgcaggctttaccccggatgaaaaatatgtcgtcgcggtggacctcggcaatgatacgattacaacgtacgcgcatgatggcggcaaattaacggaaaaagccgccctttccgtccgcccgggaagcggcccgcgtcaccttgcctttcatccggaccgaaaatttgcctactgcatgacagaactgagcaatgaagtgattgtgcttgaatttgacgaaacttccggtacgtttaaagacgtccagtatatcaaaacgattccggaggattttacggaaaacagccagggaagcgcaatccatctctcttccgacggtcgtttcgtttacgccgcaaaccgcggccatgacagcatcgccgtgtttgcagtcggtccggacggcaaactgtcccttgtcgagtacacctcaaccgaaggaagttggccacgcgactttgtgcttgacccgaccgaaaaatttatcgtggctgcaaaccaggaatcgggcacgctcgttttatacgcccgcgatccggaaaccggaatcctcactttgctgcaaaagaatgtccccgttccagaagcggtttgtgtaaaatttttgcacggataaaatgttgacccattcaaaaggcgggctccggtccgctttttgttttttccggagaaattctcatcattttatcatgttcatttcacaagtttttctttttcatgttttacatttagaacagcggcaaggaattgcagcaaaccatatttggccgggcttcccccagagcctggccaaacctccttttatcataccggccttgtgccggttttttattggtcaagtttttcggcgacggaggccagttttccttccatcgtgagctgtttgtccctgcggtcgtcgatgcggatattcgtttcaacgcgctttatgccatttgaaaaagggatttcatgcagtttttcaatgatttcaaacaggtcatggatgtccccttctattaaagtgctcatcggagtcagcttgattttcacccttccctgttcttttcccagcgccttctcaatctccgccacatatttgctgatgcttgttgaatccgttccgaccggaaatatcgtaatatcggcaatcgccaattgaatcccctcctaaatattcttctttcttattataagccaacttcacttttcatgtctcttttcatttttcttgtctattctgcttttttcatatggtttattcgaacaacccgctttctttcccttttcttgcaaaacgttcggtcatgcagctgagcagtttcttggctgcagtcccgaaaataagcgcaactgccagaaatcctgccagataaacgatatctgtgatcactgcttccatcagcatcccgccaaccgcttcacgcattaagccaatcccataagtaaatggcaaaagcggatggatatgttgaaagaaagacggttccatctggattggaaaagtgccgcctgacccggaaatttgcaggacaagcaggacaataccaagtgcttttcccgcattgccaaaaacagaaacgagtgtatagaccatcacattaaaaacagcgccaataccgataccgaacaaaataaaccaggctttttcttgcacatccacatgcaaaataaaaagatcacccgccgccgtaatcgccgactggaaaagcgcaatcgttaaaaacagcagcagtttgccgaaatagacttgccagctggcatatgcgccgccatgatggtgttcaaccgacagcagggataccaataacattgcccccacccaaaaagacaggaccgtataaaacggagccatacccgcaccgtaatttttgatagggtatagcactttttctttcagcgataccggctgctttaaaaatccgctttcttcctgtgcatcgttcttcagcaattgaatccactgatctatattgccctgtttttcaaacgaccggattttatcagccagttccctgatttttctctcagcagccggcagttccgtttcagccgttttcaattttgccttcccgattgcaagcccagttttcgtatcgcggagaatcgcctggatatccggcaggctgccttccaatttctgaaacagtttatttgcttttgcactgtcctgcccggcttgcgccacaaatgtttttaaatccgcggcgatgttggcaccatcgtttccaatcaggctgcctgcaatgaccccggcacggccggcttcttgctttagatctgcctgcaatgcttccggcagcaacccgttatgggcctgttggagaattttcccgtttaggtccttctgtttttgaaaggattggctgagtgcagtaaaccgggctgccatacgcttaagatgctccgaaccggtttcttcagcagcggttcggagcaaatcactgaacgcgtcagagatctgtttgctattttgcaagatcatcgtattttttggcgctgtttctgcaattttcgttttgtccgccagcatactcacctggttcgagacagcaggggcggcattcagtgcttccagtccggttttgatcacggtatccgtctgctcaagcaaacttccagtgtttccaaaaaagcgggacatgtcccctgagacggttttgccgtgttttgcaagcagcaggacatcgggcatcgcgccttctgcctgttttcttactgcgtctgctttcgtaatatcccgatctgccgtcctgatgatccggttaagctccggaatgtctccctccaatctaaaaacccatgctttaaaattttcaatatccggcaaatccctttcaagttcaatgccgatttgattaaacattgtaaaaatcgctttgctaacggtttttacaaattgcgcactaatttgctgtgtaatggcagacgcacccgaccctgttattttaggcgcaatcgcattgattttttcattaacggtataagtaatgaccggtttctccggcttatcacccaggatggaagccagtttttccgaaaaattttccgggatggtcaggctcgcataatattctccggtctttacgccgcgtgcggcttccttctcctgcacaaacctccagccgagcgctttattttgtttcaacttttttataacttcattcccggcgtgtactttttttccgttgatcgctgtcccccggtccaaattcacaacggctaccgcaattccttttgtgtggccgtatggatcccaggatgccttgatgttaaaccaggcatacaatgatggaagaatgatcaaggcggcaatgatcaggcttgctgcccagtttgttgtcatttttttcaaatcagttgcataaatcttccatacctttttcattggcagcctccaagtgttgttgtatctttatgttttccaaccgcttgagctgtcatgtacacgcaaaaaagcctgtgcgtctccgttttcgcacaggtaacgttaatatgatgaatgaaggccggtgcccatattcgcagtttttcaagcaacaagtccgttatttcaccggcaatgtcttgccctgcacttattcatgtccggataacgccgaaaacctgctttatttccgactgcagctgctccagtaaaggaaaagaatggtgcaacgcaatagtttctgcaatctttctatagtaccattcctgtttttcttttccacggctgaacgcattccacacgctttccccgctttttcgcaattcttcgtgtatcgttttcaagttatggagtttatctgcgcatatgagcatacaaatttcctcttctgccgtttttaatcgctcgatggtatgctgcttccgttcctcccaccgcacatttttaggcggttcagtgcaggcttcaacaatccgggcaacattgcttccaaactcggcttttatctcctcgtttgtcaccgcagtatcttcaaccgtatcatggagaagcgctgctgcgaccacttctttgcggcagccttcttttaaaagcatcatggcaaccgcatacggatgcacaatatacggcaggtcggacgctttccggtattggccttcatgtgcttttgccgcaaattcaattgctttttccaccatttccattagaaattcctctcttcatacaaagctgcttttatcatcataccaaaacggcgcggctatacatgaatgaaaatcgaaaagctcagcactacttttggacttcttaaacatcaaaagaatccttgaccggcacaaaggcacagaatattccttcccatcctgtctgaattgaaaaagaagctgatccctgcttctttttatctattttctttgcctttaccccctcgaattcttttatgttatcactttttcccacttctcgatatgctttatccgactattgcttgagcacagtgatctgccgctgtacccgctttatttctttttgctgcttttcatacgcccgtttctgctgacggaggcagaagtctaataactgcccaccatcagccgaaaaagcacccaaatctatcttttccctttttcacatgatttgagtccgttttcattctcgtaatatgaatttaatcgtattgtaatcttcctttctacctatttgtgttataacaagagtacggagaagggagttgtcttatgcacttaaaaaggcgaattgcagttatggcgtttgccatattcgttggcacggcacaactaaatgcctatgcagaaacagatcaaggttccttacagaaaaaattggatgaaaatacgcaaaccatccaaaagaaagaatcggagaaaaaagccgtcgaaagcaaaatggagaatttgcaaaaagactggaatacattgcaatcgtccattcaaaaaaataaagataatatcgcagcaaccgaagcgaaaatccagtcagcaaaagattctatcgaaaagaaaaaagaggaaattgtaaagctggaggaccaagtttctgcacgggaaggcgtgattaaaaaacgcctcgttgccatgcaaaaaaacaaccaatacgactatgtgattgaaacgattttaaacgcggaaagcattggcgacctgatcaaccgggtcagtgcagtcgcgaccctgctgaacgctgatacaagccttttggatcagcaaaaagcagaccttgcgaaaattgaagccgataaaaaagccattgcagaccaggaaaaagtgctcgaacaggagcaggcaaacttaaaaagcagccaagcaaaactgcaaacagatttaaaagaaaaggaaaaggcattgtcgggactaaaatcgaagtatgacagcattcaaaatgagttgtcacaagcggaacaaaaacaaaccgacttgaatacaaaaatcagcaacctgcaaaaagaaataaaggcacagcaggcggctgcaaaagcaagggaagaagccctcgcaaaacaagcacgcgatgctgaagccgaaaaagcagcagaagcgcaagcagaaaaaaacgcagaagcacaagcgaaaaagccagcggaagccagtgccgggaaaacggccggaaccaaacccgccgcatctgccagccacagtacgccacaaggcaaatccttttatgtgacggcaacatcttataaccatgaagatacgaagtcggacattactgctacaggatataacattaagaaaaacccgaacatgaaattgatcgctgtcgatccgtcggtcattccgctcggcagcaaagtctgggttgaaggatacggggttgccatcgcagccgataccggtggtgccattaagggccatatcatcgatgtcctgatgccgaacaaaaaagcttccatcgcatgggggcgccgtacagtcaaagtgatcatattgaattaagaaaaagcagccttgaaccgattcaaggctgcttttttatatccacctatggggtcccgtataaaatgaacttaagtttttacatcaagcccgagcaccaatttgcatgaaggaggcaacagagctgcgatattttggtcattttattaaagtgaatttcaattgttcgcgtcaaaatcaatgatcatcatggcttccgggaatacatagagagtaggaatctttagttcaacttgtatagcataaatttaggagcgggggcacggaacaaacgtgaactttttcggcagtcctttttcaggcaggcgccgggatttttttcaaagaaaaagccgggcctcccatgaagcccagccgacacattcttacaatacaggtgccatcgtttcttttaatactttaacagaatggctaaattgttcctgttctttgtcgttcagctcgatttcaaccacttcacggacgccttggcggttaataacggcaggaacaccaatgtacacatcgctgtttccgtactggccttccaaaaaggcagagactgtcaaaacactgttttcattgttcaggatcgctcttgtgatccgggtcagagacatcccgatgccgtaaaatgtggccccttttcgttcaatgatatggtaagccgcatctctcgtgttgacaaaaatatcatctaatgttttttggtcaatggttcccttttgcagatagctttcaatggtgtcataaccgatcgttgtatggctccaaaccggaagttccgtgtcgccgtgttcgccgataattgcggcatggacattgcgcgggtcaattccgaagtgggcgctcaaagagttgcggagacgcgcggagtcaagcactgtgcccgaaccgataacatgttctttcggcaggccggactctttccaagttacatatgtcaaaatgtcaaccgggttgctggcaacaagaaaaatcccgttaaagccgctgtccatgatgctcttaatcatgcctttaaaaatttttgcgtttttggcaacaagatcaagccttgtttcgcccggtttttgcggggaacctgccgtaatgacaacaagatcggcagtgccgcaatcggaataatcgcctttccaaacgcgggtcggcgtaggcgcaaatggcaggccgtggttcaggtccatggcttccccttctgcttttgcttcgttaatatcgattaaaacaagctcttctgcaacaccctgattaatcatggcgtagcagtaacttgtaccaactgcacccgttccaaccactgcaatacgattgacctttttcatgtataatcttccttcccatcaaaagtaaaaaatatatccactgtatgaaagcagttttgcaagcccggcatggcgggcccctatccagtctatggatattgtgccaactcctaatggattccatactgcttttcctttaaagcaggacgattaaacttttgcagcaaatgctgccatacggtttgtgaaagagatggacggcatgctcttttatgactgaaattgatcgttccgttcattttcttttcttccacatgggtaagtataccactatttttgtgatcagattcacatattttatggcgaaaatttgaaaattcacctgcctgcatgaaggaaaatgacggtttttccgttattatccgtttacatttttcacaaatgattttatttgaaaaggtcagatatgtaaacggtattcccttttgtgcgcactttcacaaattgacccgggcagagaaatgaatggctgatcccacccaaatgattgaatgcctgctctgtcctccaaaaacgcagaatctgcccgcttaaaaaaaatccgcatcacatgcatggaagcgtggacggcagacatcgacaaaaacgcaactgtccagtcattcaattgcgcatcataaatggacgtgatgtggacagccagtacgccgagcataataaagcctcacataaaatcaatttcatataaatgcacttttttcaaagaaagcatctccttttctcttcataccggctgctttatttgtactctaacaacgatttcttaatttattattaaagaagaaaaaaacggtttcaccgccaattcttttcttcccatccccggtacttgccccgcaaaaaacacgaatgatatttaccgttgacttttaattgttcgcattttatccttaatttatccttctatgtagggaatgttcctttgctgttttttaattttataaagtattagacttttttcattttacaagtataataataagtatcattttctttgtgcatttttctaccaaatgaaaggagcgattatccttgcatcaaattgatgaaaagaaagcaccccggatggcactgcaggcagacatggattttctcgccgggctgctggataaagtgatcctatttgaaggcggcgaagcattgctcaaaacgatccaaaatattcgctccctggcacaaaaagcgagggaaaccggcgatgaggctttctaccttcaattaaaaaaagaaattacagatctgaatccgccagaacggcaggaagtcatccgcgctttctctacctatctgcaattatttaatattaccgagcaaaatttcagaattaagcgccggcgggagtaccaatcggaagatacagaccaggttcaaccgcgttcacttgaagatggcattgaaacgctgcggaaagaaaaagtgccagctgaaatggttgcagaactgctgaacagtttatcgcttgagctgattataacggcacacccgacagaagcaacgaggcggaccattctgcaaatccacaaacgcattgcagatcttttaaaagcgctcgaatatgcaaacacccgttacgagaaaaaagtcattgaagaaacgattttgaatgagattaccattttatggcaaagttccgaaatccgcgagaaaaaaccgtccgttctcgacgaagtgaaaaacgggctttactatttcgacaatgtcctgttcgacgtgctgccgcgcatacacgaagacttggaagactatctgcacgaatcgtacggacagcgatttaaagtcccttcctatcttcattttggctcgtggatcggcggcgaccgggacggaaacccgaacgtgaccgcggacatcacctggaaaacgctcgaaatgcaacgtgaactcgtattggaaaaatataaaaagtcgcttacaacactccgggagctcctcagccattcttccaaaaaaataagcgccagccatgccctgcttgcgtctgtggaaagcgaagaaaatacaatgccggctgcaaaattatggccgacaaaagatgaaatttaccgcagaaaactgacgattatgatccataaactggaatgtgtggggaaaaacaatggcggctatcactccacagaggagctccttgccgatctgtatatgatccgggacagcgtgaaccagcaccatccggccgggcatccgattaaattgctccgcaaagtcatccgccaggtcgagttgttcggtttccacctggcatcactcgatatccgcaaccatagcggcgagcatgaatcggcccttgccgaggtgctttataacgtcaatattgcgaaggactataaaaatctgtccgaagatgaaaaagtcgcggtgctcctgaaggctctaaacgacccgcggccgatgatttcaatctatgatacttttacgccggaaacgcaggaagtcatcaatacattccggatgatcaaacgcgcccaccaaacatttggcgaacggtccatccaggtatatttgatcagcatggcacactcggtcagcgacgtgctggaagtgctcgtgctcgcgaaagaagccggcctgtaccgcgtctacccgagcggggatattttaagcgagatccatatcgccccgcttctggaaacgatcgcggacttgcggaacggcgcgaaaatgctcgaaacccttttccaaatgcccatttaccggaaccatttaaaggtgcgaggcaatctgcaggaagtcatgctcggctattccgacggcagcaaagacggcggcacgatgacagcgaactggcagctgtacaaagcacagaaagaaattcacgaaatgggcgccaaatacggcatcaaactgaaatttttccacgggcgcggcggttcactcggacgcggcggcggcccgctttattcaagccttttgtcccagccgccggttacacttggcgacggcgtgaaaatcaccgagcagggcgaagtgctgtcatcgcgctatttgctgcgcgacattgcctaccggagccttgagcaggcgacatccacgatgatgtgtgccatcacagaacaaaaacagaacgagaaaaatggcaaaacgccaaacgaagaagctgtcagggcaatggataaaatttccgaatatgcgcttgaaaaatatcaggaactcgtcttccgcgaccctgacttcctgtcttatttcaaacaggcaacgcctttaaatgagatcggtgaactcaacatcggctcccgcccgatgagccggaaagggagcgcccgtttcgaagacttgcgcgccattccgtgggtattttcctggacgcaaagccgccagctccttcccgcctggtacgcagccgggacaggcctgagcaaatatgtggaagaaaccggcaatttcaagttgcttcgtgaaatgtatgcatcatggccgttcttccatgcaacgatcaataacctgcaaatggcattgatcaaggcggagctttccacggctgaagaatatacaaggctggtgaaagatcctgaagttgccggccggattttcggcctgatcaaagcggaatacgaactgacgaaggaaatggttttaaagattgcggaccaaaaagagttgctggattacacgccgaacattaaagaatcagtgcgcctccgcaacccgtatgtcgacccgctgaacctgttccaagtctaccttatttcgcaactgcgtgaacgcgaaaacaaagatgaaaaagcccggcacctgctgatggaggtcctgcttacgatcaacggcatcgccgcagggctccggaatacaggctgatagcaatcccaaaagctctttttaaaacaaaaaaaccgttgggaaaatcattttttcccggcggtttttctcattttccggatgtttttctgaagggctgccccgaaaaggctggcgggagcccccttttttgacggaaatggtaaaaagaatgcagcacttattgtataatgggtttaagaatatgccgggggtgggccaatggatgactttatcggattgatttcagtcattttaattttttctgtgccgattgtcgcaattgtaacgaatttttttaagtcgcgtgaaaaaataagagtacaagttttggagaaagaactggagctcgaaaagttaaaaaacgaaaacttcctgctggaaacagaaaaaatgaggctggaattgcaaaaaatggagctggacgggcccaaggatgagtgggtaataagccgggaccggtaaatgtaaaacagctaaaagagcggctgctcatttgccgctctatttcacctgctgctggccgccggaaagctgtgccggaagatgctgggcacggccatccctttctccactgtggccgtctggactgtctttgtgcttgcgtctgcacggtctgccttgctttttacatagaaaagcggccctcccccgatggccgcaacaatcaaaacggctgcaatatccacttcttcatcattatgttctccttttttgttttccaattttaacaggaaccatctgttctgctttccggcttcattatggggcgcaaacttaaatttttcttaatgctttcttttcaaaatgcggatgattataaagcggcagcacagccatgcctgatacaaccgggatatgatgggaatcgacaaaaaaggatattcaagcgtagcgaatcatgctataataaacaattatatgacgaaaaaagagagggccgccgatgaagaaaaaaatcctgatgtcttttttaagcttaattgggatcctggtcatcgcctgtggcggttatgcctattatgtttatcactcggcaaaagctgcggctaataaaatgcatgaatcgctggcaggcacttcaaatgaaagcatctcaagccagaacgggcagccgatttccgttttgctgcttggtgtggatgaacgtgaaaatgacagcggccgttccgatgccatcattgtgatgaccattaatccgaaaaaaggcacgacacagctggtcagcatcccgcgggatacaaggacgctgatcgccggacgcggcacatatgacaaaatcaatgctgcgtatgcatatggcggaaccgatatggctttaaagacagttgagaactttaccggtatccaaatggattattatgtaaaaatcaacatgcaggccctgaaaaaactggttaacgcggttggtggcattaccgtcaacaacacgattgactggcatgacgaagggtactataaaaaagggtaccattacaaaaaaggggaaattcatttgaacggagcccaggcgctcggttatgtcagaatgcgccatcttgatccggaaggggatttcggtcgcaataaacggcagcggaaagtgatcgaggcgctgattcagaaagcaaccagtatttcttcggtgacaaaatatagcagtatccttgatacgcttggcgacaatgtcaaaacaaatatgacgtttaatgacatgctgacgatagagaaaaactaccggaatgccgccaaaaaaattacccagtatgaagtaaaaggcacggacaccaactttgacgggatctattatttgtcggtgtcagacgttgaaaaagaaaaagtcacgcagatgctggaagaaaatctgtctggtgattaaggaatagtggaaacaacaacccgcttcagcatgcagaagcgggttgttttgtcaacggctttcaataaaccgaatcacctcttcaagcggcgtttccgccattgacccgaggcggtggtcaatctcgccgaacttgaggtcttttgttacccggtttgggacgaccacgcatgccataccggcgcgttttgccgcaagcgacccatttggcgaatcttcgaagacgaggcattgttccggttccacgccgagacagccggccgctttcaaatacaaagcagggtccggtttgactttttccacgtcatcggaagatttgatgcagtcaaaatacgcaagcaggccaagctgacgcaaatagcggtgcagccatttcctgtcggagcttgaagccagcccgactttaagcccgagctgcctggccgactttaaatagtcttccacaccttcacgagccgcgcctgtttcgagccgttttaaaaacatttcttccagcttgtgatccagtttttctgtatcaagcggctttttgatctgctcttcaagatatttaaacggcttaaaatccgaatgcgtgccaatcccctttccccacagctcaagcggcatctcgcaatcgtagccgcgaaaaatttcacacagcacatcgtaatgttccgattccgtatccataatcagcccgtcgaaatcgaaaatgacagcttttatcatccctaaaacccctttctgtttcctttaacattatacgttaaaaacactcttcctcccagaatggttttgaaatcttttccaaaatattaaataccttattccttcacaaagttgtaaattatttctggataatgccagtatttgacaaacctatgaaaaatatatgaactttttatgaaatttttatgaaacatggtactataagggtaaatgacaatacaatctatatttttatattgtaaaataggttagcaccataataaaggtgaaaaaataaaagtaccacctttttttcatttgcttttatttgtacactattttaccaaaccggaaggagagaaaaaatgtgttgaggaaactaccttggaaactggtgctgcttttgtccctcacatcgctctttttgctcggcggatgtgacaccaaatttgcagtgctcgacccacaaggcccaatggcgcgggaacaatatcatttgattgtttactcatccatcttaatggcctttgtattcgtcgttgtccttgggttgtatctttatatggtgataaaatacagggcgtcgcgtctgccggctgattataaaccgccgcaaatccacggccataaagtgctggaaacggtgtggaccattatcccggtgctgattattatcgccattgccattccaaccgttaaagcaaactattcggttgaagaaacgccaaaatccatgaaaagcgaaaaacctttaacgatttatgtcacgtcatcggaatggaaatggattttcagttatccggaacagggcattgaaaccgttaactatgtaaacatcccggctgggcggccaatcaatttcgaattgacatcatccggtacgatggcatctttctggatccctgaacttggcggacagaaatatacgatgccgaacatgacgatgaggctgattctggctgcagaccaccctggcgaatatacaggaagaaacgcaaacttcaacggggaaggctttgcaaagatggacttcgatgtgttggcccaaacaccgaaagattttaatgcgtgggtgaaggaagtcaaaagcagagcgcctcaaatgaaaaaatcggattatgaaaaactgattaaaaaagaaggcctcgtaggaagacagacttacacgggaacccatttaaaatgggataaaccggatgaacaaaaaagctattatgaagaatcggaaaaaggtgagaaacaaaatcaccatcaccaccacgatatgtccggtatggatatgggcggaaaataatcattggaataggaggaaaacagtgtgaaacttagtgattttttcgtcaccggtgaaccggccatatatgccgccgaagttggcatggcacttggcgcggccgctgtgatcttttctctaacctatttcaagaaatggaaatggttatggaaagaatggctgacaaccgttgaccataaaaaaatcgggattatgtacattatcgttgcggtattaatgttattccgcggcggtgtcgatgctttaatgatgagaacacagcttgcactgccgaaccagcatctgcttgatgccaaccattatgacgggatctttacgacccacggggttgtcatgatcttatttatggcgatgccgtttttgttcggcctgattaacgttgctgttccgctccaaatcggggcgcgcgatgttgccttcccgcttttgaacgcattcagcttctgggcaatggttgcagggatgtgcctctttaatatttcatttattatcgggggttcccctactgccggctggacgaactacttcccgcttgcaggcacggaatttacaaaaggtgtcggaaacaactattatgcaatgggcctgcagctttccgggatcgggacactggcaacagccgtgaacttcattgtcacgattctgaaaatgagggcgccgggcatgacattaatgaaaatgccgatgttcgtatggtctactttgattacttttatcatcgtgctttttgctttccctgttttgacagtggctttggcagaagtaacgtttgaccgtactttcggcgcacacttctttaccatgggttcaggcggcagcccgatgttatgggcaaacttgttctggatctggggccacccggaagtgtacattgtgttgctgccatctcttgggatttacgcggacattatcgctacattctcgggtaaacgattgtttggatatgcctccatggtcgttgcgatggctggtatcgcattcttcagttatttcacatgggttcaccacttctttacaatggggaacacagcagtcgtaaactcgttcttctcgatctcaacgatgattatcgcgataccaacgggtgtcaaattatttaacgaaatctttacattgcataaagggaaaattagaacaacaacgcctatgctttggtcgcttgcctttatcccgacatttttgatcggcggggttacgggtgttatgctttccatggcagcagcagactatcaatatcacaattcatatttcctgattgcccacttccactatacattgattccggcagtcgcctatgcatgtttcgcagggctccactactggtatccgaaaatgttcggctatatgctgaatgaaaaactgggcaaaattacgttctggttgtggatggtcggctttaacctttgcttcctgccgcaattctttgtcggcctcgacggaatggcgcgccggatgtacacttatgaagcaggacttggctggacaggttggaacttcgcctctacagtaggtgcctatatcatggggattgggttcctcgtcctggcttggaacattgtttacagcattaaacatggcgttcgcgacacgaccggtgatccttgggatggccgcacattagattgggcaacccctacaccggttccggaatataactttgcgaaacagccggttgtctctacacttgatgcgttcgcagaatacaaagaaaacggcacaccgatttaccgggatgaagagtacaaaccgatccatatgccaaataactcggcaatgccatttttctccgctgtatcgatgggccttgcaggtttcggccttgtctggtcctggtggtggctcgccattctcggcggtttgatgatgctcggctgccttgcgtggagatcgtttgacccggataaagggcactatatcagtgtagaagaaatcattcgcacagaaaatacaagagcaggaggtgtaaaacgatgagcgacgaacatttggatacatcattgcccctcgaataccagcgcaatcaggaccgtttaaccattttcggtttctgggttttcctggcggctgaaatcactttgtttgcaacgctgtttgcaacgtattttacactccagcaccaaacagcaggcgggcctgttcagcaggacatctttgagctcaaaggtgtcctgattgaaacctttgtccttttgacaagcagttttacatgcggaattgccgtcttcaatatgcgcaaccggaataaaggcgcgatgctcggctggtttatcgttacccttcttctcggtttaactttcgtcggctttgaaatcaatgaatttgtcacgtacgttcatgatggggcaacactgccgacaagcgcattcctttccgcattctatgtattgctcggaacgcacggatgccacgtttccctcgggattttatggggaatatcgattattatacaactgatccgccgcggtttaacgccgatgacggcacgcaaatttttcgttgtaagtatttactggcacttccttgatgttgtctggatctttatcttcactttcgtttatttaggagggttgatgaaataatggagcatcattcaaaatatccgatcggccatgtcatcggttttctgctttcaatcgtattgacccttgtggcactgtatgttgctttgtataccaacctttctaaaacggcgatcatctggacaatcggattgtttgccttcctccaggctggcgtgcaattatttatgttcatgcacgtcaaagaaggcgaaagcggcaaaatcaatgttggcaatatgatttacagtattattatcgcgattgtcgtcgtttacggaaccatctgggttatgcacttttaattgccgggcaaacagaaggccagctgaatcagctggcctttttgaatgtgtaaataagggagatataaaaatttccataagaaaaacgacaaagatttaccttttgaatctgattatattactaacctgataataattttttaaaaattttaaaaatatattgacggcggtaataaaattgtgcataattagggcttgctgaataagcaaaattcctagatttggcaaggatgctaacaggttcggaaaaaattaaatgcaaggattttataaaatgttaaaactaagaaaggctggagtgttaaaaaatgattaataaaaataccgaagaaaaagatatattgttgaatgttttaggtataatcgaggctgtatataataagaaaatttcgatagaagaagctgagaaaagatattttaattaccgtatcattgattctttgaaggaaaaaaattactcaaatgaattaatagaaattttggaactgggtacagaaattgatggtattaatgatttactacctgacaagttagatgaaaacataattgatttaaaaaatagagttcttcttttgttagatagagaaataaaagcataaaaatagtccccgcagacgcgagggctttttgatttgtcctgccgtagcagtaaaagcttttcaaagcgcttgacctccaatgaacccgcacccgcaatctgtctgggttaatctttaccgctcgctgcacacgcagtcccatcgggtggtccgtgaacatccgattgtctccccaaacagaaatgctgaaaaaaggggcagttttcctagttgcattttctgtaaggaatcctgtataattaaagtcaaatatagtcaaagtcaaaagacggtgtcaggaggtggctttgatgaaaaatatatcggatatcatagaggaatatttaaaacggattctggaactgaatgaaaaagaaattcttgaaataaaacgcaatgagattgccgataagttccaatgtgtcccttcgcaaatcaattatgtcatcaatacgcggtttacgattgaaagagggtatattgttgaaagtaaaaggggcggcggcggctatatccggatcatgaaagtgcggcctgaaagcgatgcggaactgattgaccagctgcttgtgcatatcggcaatgtcatctcccagtcgaatgcggaagccatcattctccgcctcgttgaagaagaggtgatttcaaggcgggaggcaaaaatcatgctcagcgtgatggaccgctccgtgctctacatccagttgccggaacgggatgaactgcgtgccagaatgttgaaatcgatgttaacgaccttaaaatacaagtaacaatagaggtgagtatgccgtgatttgccaggaatgcaatgaaaggccggcaacgatgcattttactaaaattataaacggtgtgaaaacggaattccatctttgcgagaagtgcgcgcaggagaagggggaaaagttttcatcggattgggggaaaacctttcccttcgataatctgctcgcgggcctttttaattttgatccggccatccaacttttcaaacaggaaacagcacctgacccggatgtgcttcgctgcaaccattgcgggatgacattgaaccagtttttaaacacaagccggttaggctgcccgcattgctatgagacgtttcagcaccagcttgttccgattttgcagcgccttcatggcggcaacgttgcgcatgaaggaaaaatacctgcacggattggcggtgccatttatacaaagaaaaaattgcaggaattaaaggcggcgttgcaggaagccatcagccaggaagaatttgaaaaagcagcagaactccgcgatcaaattcgcgcacttgaaggttcttctcaagcaaaaggaggggaacaataatgtctttagaacattttttgcacaaagcgtccagctcctggatgaacgagcaagggcctgaatcggaaattgtgctgacgacacgggttcgtctggcaagaaatttaaaaaattaccggttcccgtccttgtttaccagcgaggaagcaagggaaattatgaaaacaatccaggatatcgcccgaaatcattttccggctgaaatgcaggctgaatttttaaaaatggacgaattaaaaccgctcgaaaaaagggtgcttgtggagaaacacctgattagcccgcaacttgccgaagaagcgggtgacggggcagttattttgtcaagcggcgaagatattagtattatgataaatgaggaagatcatttacgcatacaatgtctttctccagggcttcaattgcatgaaacgcttcagaaagccaatcagcttgatgacctgcttgaaaattgggtcgattatgcttttgatgaaacgctcggttacttaaccagctgcccgacaaatgtcggaacgggcatccgcgcatcggccatgatgcatttgccgggacttgtgctgacacagcaaattaaacaaatcattccggcgattcatcagcttggtttggtggtaagaggaatatatggcgaaggaagcgaagccatcggaaatatttttcaaatttccaaccaggtgacactcggaacatcggaagacaatattgtctcggatttaaccagtgtcatccggcagatcattacacaggaaagatcggcaagggaagcattggtgcagacttcaaacatacaattagaagacagggtttaccgttcgctcggtgtcctgcaaaacagcaggatcattgaaacaaaagaagcggcccgttgtttgtccgatgtccggctgggaattgatctgggctatattcaaaacatttcgaaacaaattttaaatgaattgatgattttaatgcagccgggatttttacagctttatgccggaagagcgctcagcccgtatgaaagggatatccggagggctacactgataagagaacgtttgaggcttgaggagaccaaatgaacaggaggaatgacagatgatgtttggaagatttacagagagagcccagaaagtgctggccctttcccaggaagaagcaatccgcctgaaacataacaatatcggaacggaacatattttgctcggacttgtccgcgaaggggaaggcatcgcggcaaaagcgctgtacggcctgggtttaagcgccgaaaaaatccaggaagaagtggaaaccctgatcgggaacggccaggaaatttcccaaacgatccactacacgccaagggccaaaaaagtgattgaactgtcaatggatgaagcgagaaaactcgggcactcctatgttggaacggaacatatcctcctcgggctgatccgtgaaggtgaaggcgtggcggcacgcgtgctgacaaatctcggcgttagcttaaataaagcaaggcaacaggtgctccaattattgggcaacagtgaagcgtccgtacagggcggttcggcggccagcgtcagcacaccgacactggacagtctggcccgcgatttaacagcgatcgcacgggaagattcccttgatcctgtaatcgggcgcagcaaagaaattcaacgcgtcattgaagtactgagccggaggacaaaaaacaaccctgtccttatcggggaaccgggcgttgggaaaacggccattgcagaaggccttgcccagcaaattgtgcataatgaagtgccggaaacgctgcgtgacaaacgggttatgacgcttgatatgggtacggttgtggccggtacaaaataccgtggcgaatttgaagaccgcctgaaaaaagtcatggatgaaatccgccaggccggtaatatcattcttttcatcgatgaattgcataccttaattggggccggcggtgcggaaggagccattgatgcttccaatattttaaaaccgtcgcttgcccgcggcgaactgcagtgcatcggggcaacaacactggatgaataccggaaatatattgaaaaagatgctgcactggaaagaaggttccagccgatccaggtcgatgagccgacgattgatgagtcgatccagattttaaaagggctgcgcgatcgctatgaagcacaccatcgcgtctcgattaccgatgaggcgatcgaagccgctgtaaaactttcggaccgctatatcgcagatcggttcctgccggataaagcgattgacttaatcgatgaagccggatcgaaagtgcgtcttcgttcctttacaacgccgccgaatttgaaagaactggaattgaaactggaagaggtacgcaaggaaaaagatgcggccgtccagagccaggaatttgaaaaagcggctgcgttaagggataccgaacagaaactgcgcgaacagctggaggaaacgaagaaaaactggaaggcaaaacaaggccaggaaaacagtgaagtcacagtcgatgatatagcgcttgttgtttcgagctggacgggagttccggtgacgaaactggcacaaaccgaaacggaaaggcttctgcaccttgaagagatccttcattcccgggtgatcgggcaggaagaagcggtacttgcagtggcgaaagcagtccgccgtgcacgggcaggattaaaagatccgaaacgcccgatcggttccttcattttcctcgggccaacaggggtcggaaaaacagaactggcgcgggcgcttgcggaagcgatgttcggcgatgaggatgccatgatccggatcgacatgtccgaatacatggagaaacattcgacttcccgcctcgtaggttcgccgcctggatatgtcggttttgaagaaggcgggcagctgacggaaaaggtacggagaaaaccgtattcggttgtgctgcttgatgaaattgaaaaagcgcacccggatgtgttcaacattttgctccaggtactggatgacggccggctgaccgattccaagggccgcacggttgattttagcaatacgattgtcatcatgacatcgaatgtcggcgcagatgctttaaaacgcaacaagagcgtcgggttcaccattcaggataccgtcgaggccgattataaagacatgaaggacaaagtgctcgaggaactgaaaaaagcgttccggcctgagtttttgaaccgtgttgatgaaaccattgtgttccattcgctcgagaagaaacagttgaacgaaattgtcacgttgatggcgaaagaattgtcggaccggttaaaagagcatcatatcgaacttgtgctgacggatgccgcaaaagaaaaagtggcggaaaaaggctacgatccggaatacggcgcgcggccgctgcgcagatcgattcagaaaaacatcgaagaccgcctttcggaagaaatgctgaaaggcaatataaaagaagggcaaaaggtattggtcgatgtaaaagacggcgaatttacttttgccagtgtggcagagtcggaagctgtatcgtccaattcttaatgccgaaagcaggaaagggtacaatggttttggtgattgtaccctttttttcacatatataaaatttcgcgccaaaatcaatggcgattaggataacattgcttctggcaacacataaagaaggagtactgtttcgttcaacctatgtggcggtttcttatacgattttaattcaatttcaagatactttgtatacacttatacacatagatatgagggaaagggggtttaagatggcaaaaaaaaccgtaaagtttgtttgccagaactgcggctacgagtcgccaaaatggatgggaaagtgcccgcaatgcagccagtggaaccagatggtggaggaagcggagacgccaaaacggaggggcttttttttacatccggagcctggaaatgaaaccaaagcggcacctattacgtctatagagtctaaagaagaaaaaaggacaaaggtggattttggagagctgaaccgtgtcctcggcggcggcattgttgccggatcacttgttttgatcggcggggatcccgggatcggcaaatcaacgctgcttttgcaagtgtcatcacaactggcaaagcacgggttaaatgtactgtatatttccggggaggaatcggcgaaacagacgaagttaagggcggaccggttaaacatccataccgatcatctttatgtgctgccggaaacggacctttccgtgatccagcaggcgatagatgaactgaatcccggctttgtggtcattgattccatccagacgatttaccatccggaaatccagtctgcgccgggcagtgtgtcgcaagtgagggaaacgactgcacagctgatgcggacggcaaaaacaaaaaacgtggccatctttattgtcggccacgtgacaaaagaaggctccattgccggcccacgtgtgcttgaacatatggtggatacggtcctgtattttgaaggtgaacgccataacgcctaccggatattaagggcggtcaaaaaccgctttggttcgacgaatgaaattgcgattttggaaatgaaagaatccggtttggaagaagtccagaacccttccgaaatttttctggaagaacggacaaaaggtgcagccggttctaccgtggtggcttccattgaggggacgcgcccggtccttgtcgagatccaggcgctgttggccccaacgtttttcaatatgccgcggcggatggcatccgggattgactataaccgtgtcacgctgattatggcggtgcttgaaaaacgggccggtcttttgattcagaaccaggatgcttatttaaaagtcgccggcggcctgaaagtggatgaaccggcagtggatttggcagttgctgtcagcgtggcatccagttttcgcgacaagccgacaaatgcggatgactgcattatcggagaggtcgggctgacgggggaagtcaggcgggtgtccaggattgagcagcgcgtccaggaagcggcaaaacttggtttccggcgggcgatcatcccgaaaaataatatgggcgggtggacgccgccaaaagagattcaagtgatcggcgtctccacaatccaggaagctttgcaagcggcactcggcggatgagaaagggaacaaatttccgtgccttctatgtgttctttggatcagtgcgtgagggtaccggaggaagcggaaggcactgggaagtgaaggaaagcgtggaaaaaaacggaacccacttgataagcaaataactgccgcaaatctgcgtttacaggatccgttatgatgtaaagacagaaaagacagcggctggcaggatacaaattttaaaagaaagcaggggatgtgcatgaagcctgaaaatgcccggagaaaaccgcggcgattaactggctcggtagggaaaaatacgaaggcaaacgttttaaaccctattttttgtttataatgtataaaggaggtgaacatgttgttaagacggcttatacaaatttgtttggtactgattggcggcacgctcggtgttttcctgctgcctgatttttacaagcttgtgaaagtggattatgtgttaatcaacaacccgtatgtttcagcgctgttgggggctattatcttttatcttattactttctggtccattcattatatcgttgattttgtcgattggtttgaggattcactggtaaaagtcccgatgacggaaattttttccggcacctttggccttgtgctcggcctgattattgcttatctggcaagcattccggtgcggggaattccgattgtcaatacaattgtgtcgattacacttacagtattgctcggttatatcggatttcaggtcggttttaagaaaagagaggaaattttcaatttgtttttcaaccggcagcatagacggaaaggcgggacagagcaagaagggcatccgcagcctggaaaacaggtgaagattcttgatacaagcgttgtcatcgacggacggattgcggatatttgccagaccggttttcttgacgggccgattgtgattccgctctttgtgcttgaagaattgcagcatattgccgattcttcggatgctttgaaaagaaaccggggccggcgtgggcttgatatcttgaaccggatacagaatgaactgccgatcgaagtgcaaatgtatgaaggcgattttgaagatatccaggaagttgacagcaagctcattaaactggcaaaattgatgaacgggattgtcgtgacgaatgattataatttaaataaagtatgtgaattccagaaagtcaaggtgctcaatatcaatgaccttgccaacgccgtaaaaccggttgtgctccccggcgaagagctcaatgtgcaactcattaaagacgggaaagagcatcaccaggggattgcctatttggatgacggcacgatgattgttgtcgaagaaggcaaaaattacattggcaaacgcattgatgtgctcgtgacaagcgtcctgcagacttcggcgggccggatgatttttgccaagccgaaactgcttgaaaaagcgttataatgcagcctggaacacccgcggcgccggacgcgggaagttcatacaggatgccgggggagattggatttgacagattatgaggtgattataccggcagccggatcggggaagcggatgggcgcagggttcaacaaattatttcttgaactgaacaagcgcccggtcattgcggttacagcagaagtttttttggccgatccgtcctgcaaaaagttgatacttcccgtgcagccgcatgatagggaagagatgaagcgtattttgccccgctcggaaaaaatagtatttgcccgcggcggttctgaacggcaatatagcgtacggaacgggctggaacttgccggaagctgcagtgtcattcttgtgcatgacggtgcaaggccgtttatcagcgccggatccattgcagcgctggcggcaatggccggggaaaaaggggcggcgatagcggctgttccggtaaaagacacgatcaaaagagcaaaagaccagattgtaaccgagacgattgagcggagcagcttgtggcagatccaaacgccacaagcttttcgcacgtctgtcttgaaaaaagcgcatgaagcggcggaacgggacggctttctcggaacggatgaagcctcactggtcgaacggatcggccatcctgtacatattgtgccgggaagttatgataatattaaaattacgacaccggaagatctttatttcgcagaagcgattttaaaaaagcaggggggaggatgaagatgttcaggatcggacaaggctttgacgtgcaccggttcggggagggacgtcccttgatgatcgggggagttgaaattccatatgaaaaaggtttgctcggccactccgacgcggatgtgttgcttcatgccgtagcggatgcctgtctcggggccattggggaaggggatatcggccggcattttccggatacagatgcggcatttaaagatgcggattctgcggcgcttttggcgcatgtttttcagcttgtgaaacaaaaaggatacaagctcggcaatcttgattgcacgattattgcccaaaagccgaaaatggcgccctatatcgggaaaatgcgggaaacgatcgcgcgcattttggaagcggagatcgggcaggtcaatgtcaaggcgaccacgacggaaaaactcggctttgccgggcgcgaagagggcattgcggcgcaggcggcggtactgctggagcaggcttaaccggcgtggctgcaagggtgctgaaacaacgggcagtttaaggcacgtactgcctgctggacattttaacggtgtatggcaacagaagtttcgtcaaaaatggtgcaacggagccgggcagctgttaacggaaacctttcttttgctggaacaaacataaccggtgtatcgctgcaaaatcgggacaagccgtgcggtttaggacccgcactgctgctggaaccattttaaccggtgtatggcctggagatgttttgccgaaaatggtgtaatggagcagtgcgcccggttatcggaaacccgtcttttgctggaacaagcatagcctggcgggggcactcgtggtacagtggcaattccattatcccgtcttttgctggaacaagcataatagcagatattttacctgcaagatgtgcgatggcatccatccgccggttcacgtcaatccatctttcgtccgccgaaccggacacaccaccggtttacggctttttcagacggtgatacaataaaacaagacaaaaagcgacagtttaaaggagaatcgacatggcaaacgaaatcagagtacggtacgctccgagcccgaccggttttttgcatatcgggaatgcccgtaccgcattattcaattatttatttgcacgcagcaagggtggaaagttcattatccggattgaagatactgaccagaagcggaatgtggaaggcggtgtggaaagccagctgaaatatttgaaatggctcggcatcgactgggacgaaagcattgatgtcggcggcgaatacggcccttaccgccagtcggaacgccttgatatctataaaaaatattatgaagacctgcttgaccgtgggctggcttataaatgctattgtacggaagaagaactggaagcagaacgcgaagcccagcttgcacgcggggaaatgccgcgttattccgggaaatgccgccatctgacagaagaagacaggaaacggcttgaagcggaagggcggaaaccgagcctccgtttccatgttccggaaggcaaagtgtatacgttcaacgatatcgtaaaaggcgaagtgtcttttgaatcggacgggatcggcgactttgtcatcgttaaaaaagacggcatgccgacttacaattttgcggttacgatcgatgatcatttaatgaaaatttcccacgtgctccggggggacgaccatatttccaacacgccgaaacagctgatgatttatgaagcattcgggtttgaaccgccggtattcggccatatgacgctgattgtcaatgaacaccggaaaaaattgagcaaacgcgacggtagcattatccagtttattgagcagtatgcggaactcggttatttgccggaagcactatttaattttattgccatgctcggctggtcaccgaagggcgaggaagaaattttttcgcgggaagaatttatccaaatttttgacccggaacggctgtcgaaatcgcctgctttgtttgaccgccaaaaactggcatggatgaacaaccagtatatgaaaaagctcgatttggataaagttgtggagctttcgttgccgcatcttgtaaaagcagggctcgttccggaaaaccggacacctgaagaagaacaatgggtgcgcaaactcatctctctctatcaggaacaaatgagctacggcgcggaaattgtcgaattgtcgaaaccgctcttctttacggatgaaatcacgtatgacgaagaagcaaaggagattttgtcgggagagcacgttccggaagtgctccgtgcattccttgaagaactggacagaatcgaaccatttgaagcaggcgaaatcaaaaaagcgatcaaagcagtgcaaaaagcaaccggacaaaaggggaaaaagctgtttatgccgatccgtgttgccgttagcggccagacacacggcccggaactgcaaagcctgatcgaactgctcggcagggaaaaagtaaagaaacgccttgaaagaatcacgggttaacattttttcgaaaataggatatgatatggttaaaatagatgtatgaaaaagcgttgagaaggagaagtaggaagaggacgcttcaaagagagaaccatcgccggctgaaagtggtttaagcccctccttttctgaaatgcaccttcgagcctgtatctgaacgcgtttgccagtaggatgcagcggggccgcccgttaacagggaaagttgggcagcgggcaaggcctgccgccaaacagagtggaaccgcgcgatcaagaagcgtctctgtccgttgcagaggcgcttcttttttaaattgcaggtccgatgacaaatccggctgatggaaatgcaaagcggaagaaattttataaacggacggggaatgggaaaaaaacaagcgaaaggggagtagcacatgtttaagcggttgaaggaagacattgaagtggtttttgatcaggatccggcagcacggacgtattttgaagtgatcttgacttactccggtcttcatgccatctgggcacaccggattgcgcactttttttataaaaagaaaatgttttttatcgcccgggtgatttcgcagctcagccgcttctttaccggaattgaaatccaccccggtgcacaaatcggcaggcggtttttcatcgaccacggcatgggggttgtgatcggggaaacgtgcgaaatcggcgataacgtgacggtttaccaaggcgttacgctcggcggcaccgggaaggaaaagggcaagcgccatccgacaattaaagacaatgcgttaatcgcaagcggagcgaaagttttaggttcgattacgattggggaaaatgcaaaaataggggcaggttctgtcgtattaaaggatgtcccccccaattcgacagtggtcggcattcctggcagggtcgtcgtccaggacggcgtcaaaatcaaaaaagatttaaaacataatgagctgcctgaccctgttgcggaccgcctgaacagcatgcagcaggaaatcgatgctttgcggtcggaagtggaacaactgagaaaggaaggggcaagaatgtatgagcattcagatatataatacattaacaagaaagaaggagccgtttatcccgcttgaagaggggaaagtgaaaatgtatgtatgcggcccaactgtctataactatatccatatcggaaatgcacggccggcgatcgtgtttgacacggtccggcgctatttggagtttcggggttatgatgtaaactatgtgtcgaatttcaccgacgtggacgataaactcattaaagcagcaaaagaacgcggagaagaagtgccggctttaagcgaacggtttatcaagtcttattttgaagatattgatgcgctcggttgctgccatgcagacgcccatccgcgcgtgacggaaaatatggataccatcatcgcgtttattgaaaaattaattgaaaagggccatgcctatgaatcaggtggtgacgtttactaccggacgagaagttttccggactacggtaaattgtctcatcaatcgattgacgaattgaaatcgggtgcgagaattgaaataggggaaaagaaagaagacgcccttgattttgccctttggaaagcggcaaaagagggagaaatttcgtgggatagtccgtgggggaaaggccggccgggatggcatattgaatgctcagcaatggcgaagaaataccttggcgatacgatcgacatccacgcgggcgggcaggacctgacttttccacaccacgaaaatgaaatcgcccagtcagaagcgttaacagataaaccgtttgcccgttactggatgcataacggctatatcaatattgataacgagaaaatgtcgaagtcgctcggaaacattgtgcttgtccatgacatcatcgagcggcacgatccgcaagttttacgctttttcatgctgtcggtgcattaccgccatccgatcaactacagcgaggaactgcttgccaatgcgaaggcagggcttgaacggatcaaaacgtcgtaccaaaatgtaaagcaccggcttgaatccagtgcaaatctggcagaagatgatgaaaaatggctggaacaggtccgttcgctccatcgccagtttatcgaggcaatggatgatgatttcaatacggcaaacggtatttctgttttgttcgaactgtcgaagcaggccaattattacttgcggggaaaaaatacgacagaaactgttctccgggcatttatgaaagagtttgaaacgatttccggcgttctcggcctgaagctcgaggaagaagtgcttttggacgaagaaattgaagcgctgattgaaaaacggaatgaagcaagaaaggcacgcaatttccaactggctgacgaaatccgtgacaagttgaaaagcatgaatatcattcttgaagatacgcctcaaggggtgagatggagacgcttatgacggtcacccttgatccgaaacaactgaacagccttgcgcttgcttatatgggagatgcggtatatgaagaatatatccggcaccatgtccttttgcagggaaaaacgaagccgaaccgccttcaccgggaagcgatccgctttgtttccgcgaaggcgcaggctcaagttttaaaacagatgatgaacgaagatcttttaacggaagaagaaaccgctgttgtccggcgtggcagaaatgcaaaatcgggcacggttccgaaaaatacggatgtccagacataccggcacagcactgcatttgaagcgctgatcggctatcactatttatccggcagccgggagcggatggaggcgctgattgaaaaagcaataggcattgtcgaagaccagaaaggaggggcgcgctgatggaccaggaatacattgctggcaaaaacccggtgctggaagcgttaagagcgggccgggaaatcaacaaaatctgggttgcggaaggttcacaaaaaggcgccatgaagcaggtgatggagcttgcaagggaaagaaaagtgaccgtccaatttgtcccgaaaaaaaagattgaccaggtggctgacggggcgcatcagggtgtactggcgctcgttgccgcttaccggtatgcagaaacaggcgatatgttcaaacttgccaaagagcggaatgaacacccgtttatcctgatcctcgatgaattggaggatccgcataatctcggctcgattttacggacggctgatgcggtcggcgcacacggcgtcattatcccgaaaaggcgctcggtcgcattaacagcaacggtggcgaaagcttcaaccggcgcgattgaacatatcccggtggcgcgggtaacaaacctttcgcaaacgattgccggcttaaagcagcaagggctgtggattgcgggaaccgatgcttccgggacgaccgattaccggcaaatggatgccgatctgccgctatgtcttgtcatcggcagtgaagggaaggggatgagcaggatcgtaaaagaagcatgcgactttctgatccgccttccgatggcagggcatgtgacttcgctcaacgcgtccgttgctgccggcctgctcatgtatgaggtttacaggaagcgccatccgcttggtgaataaaatgaatattttgctggtggacggctataacatcattggcgcctggccggaactgcaaaaattgaaacaaaaagaccttggcgccgccagagaccggcttgttgagatcatggcggaataccagggctatacggatgacaaagtcatcgtcgtttttgatgcttacggggtgaaaggcctggaaaaaaagtaccgctatcacaaagtggaagtcatttttacaaaagaaaatgaaacggcagatgaacgcattgaaaaaatggccattaaactgaacaacatccgcacgcagatttatgtggccacatctgatttcactgagcagtggcaaatattcggccaaggcgctttaagaatttcagcacgcgaactgttgaccaaagtggaaatgattgaacaaaagattaaaaagaatgtaaaatcaattcaagaggaaaagccggcaacaagaataccgttaagccaagaggtcatggaaattttcgaaaaattacgcaggggaaaacgatgagcggttgacgattgaaaattctgtactgtataatagcttttatcgaatgctcatggggggatacaggtgaacctgaacattgaggcagcatatgaagaaagatatggcacgatgcaggatgaagagttggttggacggatacacaacggcgaaagtgaagcgttggattacttgatccaaaaatacagaaattttgtcagggcaaaagcgcgttcttactttatcatcggggccgaccgtgaggatattatccaggaaggcatgatcgggctgtataaggccatccgcgactacagagaggacaagctcacgtctttcaaggcttttgctgaattatgcatcaaccggcaaatgattaccgcaattaagactgccacccgccaaaagcacataccgcttaattcttatatttccctggacaagccaatttatgatgaagaatctgaccgtacgttgatggatgtcatcaccggcgcgaaaatttccaatcctgaagaattgattttaatccgcgaaaaatatgtccatatagaagtgaaaatatccgaactgttgagcgatctggaaagaaaagtgctcgccctttacctggacgggcagtcctaccaggaaatttcagaagaattaaaccgtcatgtaaaatcaattgataacgctttacagcgcgtcaaaaagaagctggagcgcctgttggaaatgagggagatgacttactgagaaggtgttgtaagccgtttttccgccaggctgtttttcccgaatgcaagtgcaacattaaggcgtacaaaagcacgtctttaaatgcccggtattcaatgctttcgggaaaaacccggcacatcccttctcctgctactaattgacacaagctttctgccgtgttatgttgatttgtaggattttatgttttgatacgataccggcgcggaaccggcagcatccaacagattctcccggtttttcggggatctttacagcggcgggttccgttaacgccgtaagatcataagacagctggtgatgagatgcagaaaaaaatggtacttgcctgttcggtttgcggttcgcgcaattacacgactacaacgggcaacggaaaggctgaaagaatggaattaaagaagttttgcaagcactgcaacgaacacaccatccaccgcgggacaaaataacaacgaacatgagcttacttggaggtcttaaatacatgtccatcacaaatttttttcgtaatgttgcttccgaaatgcgaaaagtcagctggcctgggcgcaaagagctggtcaaatacacgattacagtccttgtaacagttgccttcctgacattgttctttattgtcatcgatctcggtatttccgcagtgatccggtgggctgaaaactcattgtaaaaggatcatttttcacttgaatatccaatgataaaacatggtataatgggagtatcataagcaacgactcaaacccggttagcgggttttttcatttgcccaaaaaatcaaaagaccaacagggagggacggacatcaagtcctattaaatggaaaaaaactggtatgttgtccatacgtattcaggctatgaaaataaagtcaaaaccaatttggaaaaacgtgtagaatcaatggggatgcaggataaaattttccgggtagtggtgccggaagaagaagaacttgaagtgaagaatgagaagaaaaaagtggtgaaacgaaaagttttcccgggctatgtcctggtggaaatggtgatgacggatgattcctggtatgtcgtccggaacacgccgggtgtcaccggttttgtcgggtcgtcgggaggcggttccaagccgacgccgcttttgcctgaagaaattaataccatcttgaaacggatgggcatggaagaaaaacgggccgatgtggactttgaaatcggcgagacggttacggtaaaagaagggccgtttgcaaactttgccggcaagattgtggaaatggaccgtgacaaaggcagggcaaaagtcatggtcaatatgttcggtcgggatacaccggtagagctcgtttttgaacaaattgataaaatataacgggataaaacttgaaatcgatatgctgagatgttaatatgttataagtcagtatgttctttgcggatggcccgctgaccgggatcccacaaagaacagacacaatgcaatcacatgatcttatgatacactcgtgacgcgggtcatgagatgaaatggcttcggatatggcttgtctttttagcttgtccattgtccggctaaccgcaagaacttgcggggatagcctgcgaagatacggagcatgtttcgttatctgcaggaagctcgcggctttagccgtgaggggttcaatcaaacagatgagtgggagggcttagtccctgttaccacatcacggacttaaggaggtgtgtctcgtggctaaaaaagtagtaaaaattgttaaattgcagattcctgccggtaaagcaaaccctgcaccgcctgttggtcctgcattgggtcaggccggcgtcaatattatgggattttgtaaagaatttaacgctcgtactgcagatcaggcaggcttgattatacctgttgaaatcacggtgtttgaagaccgttcatttacattcatcacaaaaaccccgccagctgcagttttgctgaaaaaagcagccggcattgaatccggttctggtgagccaaaccgtacaaaagtggcaactgtgaagcgtgacaaagtgcgtgaaatcgcagaaacaaaaatgcctgacttaaatgcggcaagtgttgaagcggcaatgcgcatggtggaaggcacggcgcgcagcatggggattacgatcgaagactgattcatgcagtactagttctgtccaacggggttgcgatgcgatactggctcgcaacctttttcgtgggaggttattccgttaaaaccacattcgaggaggaaatacaaatggcgaaaaaaggaaaaaaatatgttgacgctttgaaactcgttgaccgttccaaagcttattcggctcaggaagccattgaactggtgaaaaaaacaagttttacaaaatttgatgcaacagttgaagttgcattccgcctcggcgttgatccgaaaaaagcggaccagcaaatccgcggtgccgtcgtgcttccaaacggaacagggaaaacccagcgcgtgcttgtttttgcaaaaggcgaaaaagcaaaagaagcggaagcagctggtgcagattatgtcggcgatacagactacatcaacaaaatccagcagggctggtttgattttgatgtcatcgtggcaacgccggatatgatgggcgaagttgggaaactcggacgcatccttgggccgagagggttaatgccgaacccgaaaaccggcacggtaacatttgatgtgacaaaagcggtccaggacattaaagccggtaaagtcgaatatcgtgttgacaaagcgggcaatgtccatgccccgatcgggaaagcctcttttgaaccggaaaagttggttgaaaacctgtcaaccttgtttgacacattgatgaaagcaaaaccgtcagctgcaaaaggcacttacatgaagaatgtttctgtcacatcgaccatggggcctggcatcaaagtagacccgtcttcttttgtggcagcaaaataatgatttgacatgctgcctgcgggctgctataattaagaacggttttaaaaagtaaacatttgtaccgtagacagcaggtgccggagggcttaatttcctgccgaggtaatgcgtataaatccgggggcgccttaaggcctccgcatgcatgaaacctccatgtctcgggatatggaggttttgttttggtataaatgttcatcaagaatatctgtaggaggtgtcaagatgggcagtgcaattgaacaaaagaaacaactggtggatgaaatcaccgataaattcaaatcaagtacagccgttgtggttgtcgattaccgcggtttaaacgtggctgaagtaactgagctgcgtaaacagctgcgcgaagcgggcgttgaatttaaagtgtataaaaacacgatgacgcgccgtgctgtagaagcagccgggatggacggattgaacagcgcgctgaccggcccgaatgcgatcgcattcagtacggaagacgtggttgcgcctgcgagaatccttaatgatttcgcaaaagaccacgaagctttggaaatcaaagcaggtgtcattgaaggcaatgttgcaaccgttgatgaaatcaaagcactcgcaaagcttccttcacgcgaaggcctgctttccatgcttctcagcgtactgcaggcgccaatccgcaactttgctcttgctgcaaaagcagtcgcagatcaaaaagaagaacaaagcgcataagttttacggaatatactttaaaaaaatatcttgtaggaggatatgaaaatgacgaaagaagaaatcatctctgctgtcaaagaaatgacagtgcttgaattgaacgatcttgtgaaagccattgaagaagaattcggcgtaaccgctgctgcaccggttgctgttgctggcggcgctgcaggcggggaagctgctgcagaaaaaacggaatttgatgttgtgctgactgaagtaggcgcacaaaaaatcaaagtcatcaaagttgtccgcgaaatcacaggccttggccttaaagaagcaaaagaactcgttgataatgctccaaaaccgcttaaagaaggcgtatcgaaagaagaagccgaagaacttaaagcgaaacttgaagaagttggagccggcgtagaagtgaagtaagactctttttaaagcaaaagcccgcatttggcgggcttttttcaacatctcttcttcctgaatcctccaagaaagagtgggacttttcatggctgaacattactactcgcaaaaccctgaagcaaagcatcaaccgatagatttcacctttacattgagaggccatacctttcattttcaaacagaccaaggggttttttcaaaaaaagaagtcgacttcggctcccgcgttttgcttgatctggtgaccatgcctgaaacggaagggccggtccttgatatgggttgcggttacggaccgatcggccttgcacttgcaacatcttttcccggccgccatgtgcatatggtggatattaatacaagagcggtcgagctggcggagaaaaatgctgcccggaaccatatttcaaatgtttccatatacgaaagcaatctttttgaaaatgtgaaaagcggcccgtttgccctgattgctacgaatcccccgatccgcgccggaaagcagatcgtgcaccggatttttgaagaaagctaccaatatctcgcaaaaaacggggaactttgggtggtcatccggaaaaagcagggcgccccttctgccaggaaaaaattagaaagcatatttgatgaagtggattgtgttggaaaagaaaaaggatattttgtttttaaagccaaaaaaatttgactcccgatttcatatatgttaaaatcataaaatgccaatagattaaggttctttatgcaatttaagctatatttgtcaagtatatattttggatgaattggaaaatacttataaaatcataagctcgtcatgcgatatgtggttttttcataaaaaaccctttttctttttgccttagctttattgttgtttgacgaaagatgcaaacaaaacgcttgatttgaggggtgaatcagttgtcacatcaactagttcagtatggacggcaccgccagcgcagaagttacgcgcgcatcaaagaaattttagagctgccaaaccttatcgaaattcaaaccgcatcttaccaatggttccttgacgaaggtttgcgtgaaatgttccaggacatctctccaatcgaggattttgccggaaacctgtcgctggagtttattgactacagcctcggcgaaccgaaatattccatcgacgaatgcaaagagcgcgatgtaacatacgctgctccgcttcgtgtaaaggtgcgccttgtcaataaggaaacaggtgaagtaaaagaccaggacgtgttcatgggcgatttcccgttaatgaccgaaacggggactttcatcattaatggcgcagaacgtgttattgtatcccagcttgtccgttcccctagtgtttattttaacagcaaaatggacaaaaacgggaaatacggctacaccgcaacggtcattccgaaccgcggcgcctggcttgaatatgaaacagatgcgaaagatgtggcctacgtccgcatcgaccgcacaagaaagctgccgatcacggttctcctcagggcgctcggtttcggctctgaccaggaaattattgatctgatcggtgataatgagtacttaagaaatacgcttgaaaaagataatactgaaagcacggaaaaagcgcttcttgaaatatatgaacgcctccgtccgggcgaacccccgaccgttgaaaatgcaaaaagcctgctgatttcgcgtttctttgatccaaaacgctatgatctggccaatgtcggtcgttacaaaatgaataaaaagcttcacctgaaattccggctgttcgggcaacggctggctgaatcaatcgcagaccctgaaaccggcgaaatcatcgcggaggaaggaaccgttttagaccggcgtacgcttgataaaattgtgccttttctcgaaaaaggcctgaagtttgaaacgtacagccagactggcggcgttgttgatgatgatgttactttgcagtccatcaaaatttatgccccgattgacgataacgaaaaagtcatcaatgtaatcggaaatgcttatgttgatgaaagcattaaacatattacacctgcggatattgtggcttccattagctacttctttaatttgctgcatggcgtcggcaatacggatgatatcgaccacctcggtaaccgccgtttacggtctgtcggcgaattgctgcaaaaccagttccgtatcggtctttcccggatggaacgcgttgttcgtgaaagaatgtcgatccaggacattaacaccattacgccgcagcagctgatcaatatccgtccggtcattgcggccattaaagaatttttcggcagttcgcagctgtcccagttcatggaccagacaaacccgcttgcggaactgacccataaacgccggctgtcggcactcggcccgggcggtttgacccgtgagcgcgccgggatggaagtgcgtgacgtgcactattcccactacggccgcatgtgcccgattgaaacgcctgaaggcccgaacatcggcttgattaactctttatcaacctatgcaaaagtgaaccgttttggctttattgaaacgccttaccgcagggttgatccggatacagggcgtgttacggagcatattgattatttaacggctgatgaagaagacaattatgtcgtcgcacaggcgaacgcacagctggatgaaaacggctttttcgttgacgatgaagtatatgcgcgtttccgcggtgaaaacattgttgtcaaaacagaccgcgttgattatatggacgtttcgccgaagcaggttgtatcggctgcaacggcatgtattccgttccttgaaaacgacgactcgaaccgtgccctgatgggtgcaaacatgcagcgccaggctgttccgcttatgaacccgcaagcgccgattgtcggcaccgggatggaatatgtcaatgcgaaggactccggcgcagcacttatctgcaaacatgacggtattgtcgaacatgtggaagccagggaaatctgggtgcgccgcgtcatcgatgtcgatggccaggaagtaaaaggcgaccttgacaaataccgcctgcaaaaattcaaacgttccaacaatggcatgtgcattaaccagcgcccgattgtgaaaaaaggcgaccgtgtggtaaaaggcgaaattttagcggatggccagtcaatggaccacggcgaacttgcccttggccagaacgtgctcgttgcttttatgacatgggaaggctataactatgaagatgccattattatgagcgaaaaacttgtaaaagaagatgtgtatacttctatccatattgaagaatacgaatctgaagcgcgcgatacaaaactcgggccggaagaaatgacccgtgacatcccgaacgtcggggaagatgctttgaaaaaccttgacgaacgtgggattgtccggatcggtgccgaagtaaaagacggcgatttgcttgtcggaaaagtcaccccgaaaggcgttacggaactgacagcggaagaacggctgctccacgcgattttcggtgaaaaagcgcgcgaagtcagggatacatcgcttcgcgttccgcacggcggcggcggcatcgtgctcgacgtcaaagtgtttacacgtgaagccggggatgaactcccgcctggcgtgaaccagcttgtccgcgtctatattgtacagaaacggaaaatccaccagggcgacaaaatggccgggcgccacgggaacaaaggggttatctcccggattcttccggaagaagatatgcctttcctcccggatggtacacctgtccagatcatgttgaacccggtcggcgtgccttcccggatgaatatcggccaggtgcttgaacttcaccttggcatggcggccaaaaaacttggcctccacgtggcgacgcctgtattcgacggcgcgcgcgaagaagatgtatgggaaacgattgaagaagccggcatggcacgcgatgcaaaaacggttctttatgacggccgcaccggtgagcctttcgacaaccgtgtgtctgtcgggattatgtatatgatcaagctcgcccacatggttgatgataaactgcatgcccgctcaacaggcccttactcgcttgtcacccagcagccgctcggcggtaaagcgcagttcggcggccaacggtttggcgaaatggaagtatgggcgcttgaagcctatggcgcagcctatacgctccaggaaatcctgaccgttaaatcggacgatgttgtcggacgtgtgaaaacttatgaagcgatcgtcaaaggggaaaacgtccctgaaccgggtgtcccggaatcgttcaaagtgctgattaaagaacttcaaagtttgggacttgacgtgaagattctttccggcgacgacgaggaaattgaaatgcgtgatctcgaagacgacgatgacctgaatcaggccgatacgctgaatattgcgcctgagacaaaagaagaaccggaaggaatcggggcatccaaagactaatcgtttatgttgctgggaacaaacagaggcttttgcccggattgtatgccttcgtacaatccggcttctgtttctgtttcttctgcgtgtgttttaaggtatgaacctaaagacgaaagggaggctggccccttgctggatgtaaataattttgagtacatgaaaatcggtcttgcttcaccggataaaatccgatcctggtcatacggtgaagtaaaaaaaccggaaacaatcaactaccggacgttaaaacctgaaaaagacgggcttttttgcgaacggattttcggaccgacgaaagattgggaatgccattgcgggaaatataaacgcgttcgttacaaaggcgtggtttgtgaccgctgcggcgtggaagtaacaagatcaaaagtgcgccgggaaagaatggggcatattgaacttgccgcccctgtttcgcatatttggtacttcaaagggattccaagccgcatgggccttgtgcttgacatgtccccgcgcgccctggaagaagtcatttacttcgcatcttacgtcgtaacggaagcaggcgacacttctttggaaaagaaacagcttctttccgaaaaagaataccgtgcctaccgtgaaaaatacggcaacaaattccaggcaggcatgggcgcggaagccattaaaaagctgctgcaagatgtagatgtcaacaaggaatgcgaaatactgaaagaagagctgaaagttgcccaggggcagcgccgtacacgcgccatcaaacgccttgaagtactggaagctttccgtaattccggcaataaaccggaatggatggtgctggatgttctcccggtcattccgcccgaactgcggccaatggtacaactggaaggcggccgctttgcaacatccgacttaaatgatttgtaccgccgtgtgatcaaccggaacaaccgcctgaaacgcttgcttgatcttggcgcgccaagcatcattgtccaaaatgaaaaacggatgctgcaggaagccgttgacgctctgattgacaacggccgccgcggacgtccggtaaccggcccggggaaccgcccgttaaaatcgctttcccatatgctgaaggggaaacagggccgtttccgccaaaacctgctcgggaaacgggttgactattccggccgttccgttattgttgtcggcccaaacctgaaaatgtaccaatgcggcctgccgcgcgaaatggcgattgaactgttcaagccgttcgtgatgaaagaactggttgaaaaaggcctcgcccataatattaaaagcgcaaaacggaaaattgaacgtttgcagcctgaaatttgggatgtccttgaagaagtcattaaagaacaccctgtcctgttgaaccgtgcgcctactttgcacaggctcgggatccaggcgtttgaaccgacgcttgtggaaggccgtgcgatccgtctccatccgctcgtatgtacggcttacaacgcggactttgacggcgaccaaatggcggtccacgttccgttatccgctgaggcacaggcggaagcgcgcatgctgatgcttgccgcacaaaatattttgaatccgaaagacgggaaaccggtcgttaccccgtcccaggacatggtacttggcaactactacttaacgcttgaacgtgaagatgcagtcggtgaaggatctgtcttcaaagatgtaaatgaagtgtacatggcttattacaacggctacgtgcatttccatacgagaattgccatttatgccgggtcgctgaacaacccgacgttcacggaagagcaaaacaagaagctgctgattaccacagtcgggaaagtgatcttcaatgaaattttgccggagagcttcccatatattaatgaaccgacgaaaacaaatcttgaagaaaaaacgccggataaatactttgttgatccttcgattgacgtaaaagcgcatattaaagaacagccgttaatccgcccgtttgtaaaaggcttccttggcagcatcattgccgaagtgttcaaacggttcaagattacggaaacatccaagatgctcgaccgcttaaaagatcttggcttccattattcgacaaaagccgggattaccgttggtgttgcggatatcgtcgttttaggcgagaaggaaaaaattctttcggatgcccagaaaaaagtcgatacggtcatgaaacagttccgccgcggtttaattaccgaagacgaacgctatgaccgcgttatttcgatctggagcggggctaaagacacgatccagggcaaactgatggaatcgctcgataaacggaacccgatttttatgatgagtgactcgggggcccggggtaacgcgtcgaactttacacagcttgccggcatgcgcggtttgatggccaacccggccggccggattattgaattgccgattaagtccagcttccgtgaaggcttaaccgtgcaagagtactttatttcgacgcacggtgcccgtaaaggccttgccgatactgcccttaagacggcagactcgggttatctgacacgccggcttgttgatgtggcgcaggatgtcatcattcgtgaagacgactgcggcacagaccgcgggcttttgatcagtgcgttgaaagaaggcaatgaaatcattgaatcgcttgaagaacggttaaccggccgttattcaagaaaaacgatcaaacatcctgaaacaggcaaagtgatcattgaggaaaacggctttatcacggaagatatcgcgaaggaaattgtcgatgccggctatgaaaaagtctggatccgttcggccttcacttgcaatacccgccatggcgtatgtaaaaaatgctacggccgcaaccttgccaccggccaggaagtggaagtcggcgaagcagtcgggattattgccgcccaatcgatcggcgaacctggcacacagctgacgatgcgtacattccatacaggcggtgttgccggggatgacatcacacaaggtcttccgcgtattcaggaattgtttgaagcccggaacccgaaaggccaggctgtcatttccgaagtggaaggcgttgttacttccatcagcgaagggcgcgaccgccaatatgaaattgtcgttcagggcgctgtcgaaacgcgcacctatacggccccttatacttcccgcttgaaagtggcggtagatgaccacgtcgtgcgcgggcaggagctgacggaaggttccattgacccgaaagacctgttgcgtgtaacggatgtcacaaccgtacaggaatacttgcttcgtgaagtacagaaagtttaccggatgcaaggagtggaaattggcgacaaacacattgaagtgatggtccgccaaatgctgagaaaagtaagggtgctcgatgccggcgacacggatgtcctgccgggaacattgcttgatatccatcagttcggtgaagcgaatgaaaaggcgctcaaggaaggcaaccgccctgcaacaggccgccctgttctgctcgggattacaaaagcttccttggaaaccgattcgttcttatcggcagcctccttccaggaaacgacccgcgtattaaccgatgcggcgatcaaggggaaacgcgatgaactgctcggcttgaaagaaaacgtcattatcgggaaactggttcctgcagggacgggcatgacccgctatcgcaaaacggttcctgaactggtgaaaaaggaagaagaagtgccggctgaataatgcggcggcagcaccggcaaaaaccggtgctgcacctttttctgttttttagcaaaaaaagcatggcttttttacacgggctgttgactttagattttcaaagtgataatatattcaaggtgctcctatgaatacctgtatactttggaggatattgcgatgtcttatgaaaaagtaaatcaggcgaaaagaatcgttgtagggacaaaacaaacagcgaaagcgataaagtccggaaatgtggatgaactgctcgttgccagagatgctgatccgaatattacgggcaaagtcatttccgttgccgaacaattcaatgtgccgattacgtatgccgattcgaaaaaacaactcggaaaagtatgcggcattgaagtcggagctgcagctgttgcacttatttattaaacactttttgcgggagaatccgcaaaaatttgtttttgccattaaatgaaccacctggatgtgtggacttaaattgttcgaagggaggaaaaacagatgcctactattaaccaattggtgcgcaaacctcgtaaatcaaaaatcgagaaatccaagtcacctgcgctgaataaaggctataacagtttcaaaaaaatcaataccgatctttcttcaccccaaaaacgcggtgtatgtacccgtgtggggacgatgacgccgaagaaaccgaactcggcgctccgtaaatatgcccgtgtccgtttaacaaacgggattgaagtaacggcttatatccctgggatcggccataacctgcaggaacacagcgttgttttaatccgtggcggacgtgtaaaagacctgcctggtgtacgttaccacatcgtgcgcggtgcacttgacactgccggtgttgacaaccggaaacaaggccgttcgaaatacgggacgaaaaaaccgaaagaaaagaaataataagaacgataaccatacttgaaaggaggatcatttatgccacgtaaaggacctgtcgcaaaacgcgacgtattaccggatccgatttacaattcgaaactggtcacacgtttaatcaacaaaatgatgatcgacggcaagagagggaaagcccagactatcctgtattcttccttcgatattatccgtgaacgcactggcaaagatccaatggaagtttttgaccaggcattgaaaaacattatgcctgtacttgaagtaagagctcgccgtgtcggcggcgcaaactatcaggtgccggttgaggtgcgcccggaacgccggacaactttagggcttcgctggctggtcaattatgcccgccttcgcggagaaaaaacaatggaagaacggctggcgaacgaaatcatggatgcggccaacaatacaggcgctgccgtgaaaaaacgcgaagatacgcataaaatggcggaagcaaacagagcgtttgcgcattatcgctggtaatattccgatactcctacattacacctattaaggaaggagaaagtacgagatgccaagagagttctccttagaaaagactcgtaacatcggtatcatggcgcatatcgatgccggtaaaactacaacaaccgagcgtatcctttattataccggccgtattcataaaatcggcgaaacgcatgaaggtgcgtctcaaatggactggatggagcaggaacaggagcgcgggattacgattacttccgctgctacaacagcgcaatggaatgaccaccgtatcaacatcattgacaccccgggacacgtggacttcaccattgaagttgaacgctcccttcgtgtccttgacggcgcggttgctgtcctcgatgcccagtccggcgttgagccccagactgaaaccgtttggcgccaggcaacgacttacggtgtaccgcggattgtatttgtcaataagatggataaaatcggggccgatttcttgtattctgtcagcaccctgcatgaccgcctgcaggcaaatgcacatccggtccaattgccgatcggtgctgaagacaactttgtagggatcattgaccttattgaaatgaatgcaactttctacggcgatgatctcggcacgaaaattgaagtgcgcgaaatcccggatgagtaccgtgaccaggcggaagaatatcatgaaaaactgcttgaagcagttgctgaagttgatgaagatattatggaaaaatatcttggcggagaagagatttcaaaagaagaactgaaagctgccatccgcaaagcaacctgtaatgttgaattcttcccggtactgtgcggctcggcatttaaaaacaaaggtgtccaattaatgctggatgcggttgttgactatctgcctgcgccgacggatgttccttccatcaaggggacgcttccggatacaggggaagaagtattcaggcattccagcgatgatgagccattctcggctttggccttcaaagtcatgacagacccgttcgttggtaaactgacattcttccgtgtttattcaggcacattaagcgctggttcttatgtcaaaaactcgacaaaggacaaacgcgaacgcatcgggcgtattttgcagatgcacgcaaaccaccggaaagaaatcgacatggtttatgccggcgatattgctgctgctgtcggcttaaaagacacgacaacaggcgatacgctttgcgacgataataatccggtcatccttgaatcgatggaatttccggaaccggttatccagttgtcggttgaaccgaaatcgaaagccgaccaggataaaatgatgacggcgctgcaaaaactgcaggaagaagacccgactttccgtgcccatacgaatccggaaacgggacaaacgatcatcgaaggtatgggtgagcttcacctcgacattatcgttgaccgcatgaaacgcgaattcaaagttgaagccaatatcggtgcgccgcaagttgcgtaccgtgaaacattccgcaaatccgcacaagtccaaggtaagtttgtacgccaatccggcggccgcgggcaatacggggatgtttggattgaattttcaccaaacgaagaaggaaaaggctttgagtttgaaaatgcgattgtcggcggtgtcgttccgcgcgaatacattccggcgatccagtccggccttgaagatgccatgcagcgcggtgtacttgccggctatccactcgttgacattaaggcaaaactgtatgacggttcttaccacgatgttgactcgagtgaaatggcatttaaagtggctgcctcccttgcattgaggaatgcagcatccaaatgcgatccggtcctgcttgaacctgtcatgaaagtggaaattgtcattccggaagaatatctcggcgacatcatgggacaagttacagcccgccgcggccgtgtggaaggtatggaagcacgcggaaatgcccaggttgtccgtgccatggttccgttgtccgaaatgttcggttacgcaacagcacttcgttccagcacgcaaggacgcggtgtcttcacgatgacatttgatcattatgaagaagtgccgaagtccattgcggaagagatcatcaaaaaaaataaaggcgaataattgatttattgccttcaatgaagtataactttactagattggttcaaagcgctttaaagctgtcctttcagctttaaagcatccatatacttactcaatccaaaatattaaggaggatttcctgatggctaaacaaaaatttgaccgttctaaagaacactgtaacattggaacaatcggtcacgttgaccatggtaaaacgactttgactgctgcaattactgctgttcttgcaaaacaagggaaagcagaagcaagagcatatgaccaaattgacggtgctccggaagaacgcgaacgcggtattaccatcaacactgcgcacgttgaatatgaaacggaaaaacgccactacgcacacgttgactgccctggacacgctgactatgtgaaaaacatgattactggtgctgcccaaatggacggcgcgatcctggttgtatccgctgctgacggcccaatgccgcaaacgcgcgaacacatccttttgtcccaccaagttggcgtgccttacatcgttgtgttcctgaacaaatgcgacatggtggacgacgaagaattgcttgaacttgttgaaatggaagttcgtgaccttctttccgaatacgacttccctggcgatgaagtgccggttatcaaaggctctgctttgaaagctcttgaaggcgaccctgaatacgaagcaaaaatccttgaattgatggatgctgttgacgaatacatcccgactccgcaacgtgacacggataaaccgttcatgatgccagttgaagacgtattttccatcaccggccgtggtacagttgcaaccggccgtgtagaacgcgggcaattgaaagtcggcgatgttgttgaaatcatcggtttgaacgacgaaccgaaacaaacaacggttaccggcgttgaaatgttccgcaaactgcttgactatgctgaagctggcgacaacatcggtgcacttctccgcggtattgcacgtgaagaagtccaacgcggccaagttttggcgaaaccgggttctattacaccgcatacaaaatttaaagcacaagtttacgtattaacgaaagaagaaggcggacgtcacactcctttcttctctaactaccgtccgcaattctacttccgtacaacggatgttaccggcattattacgctgcctgaaggcgttgaaatggttatgcctggtgataacgttgaaatgagcgttgaattgattgcccctatcgcgatcgatgaaggaacaaaattctcgatccgtgaaggcggccgtacagttggcgccggttctgtttcttccatcgaagcttaatcggctatttaaaaaaaagcccggccaggtcatcccggccgggctttttccatgcttacgcgcccgggttgcagcaatgttttccaaaacttgatgttgcgccatagggcctgtataataaaaaagtcactgaaatcagcagcatatcaaagtttatgttgcattacacccggattttgtgtataatgtttgatgttggtctttgactgcgatgaagtgggaggttgctggcacacccggccgctttgccatggcgcgtgggccaggaaaatttccatggagaatgtctattagcaaataggcgataaaggagggaaaataatggcaaaacaaaaaattcgcatacgtttaaaagcatacgatcacagaattctggatcagtctgcagaaaaaattgtagaaacagcaaaacgatcaggtgcaaacgtctccggtccgattccgcttccgactgagaaatccgtttacaccattctgcgtgctgtccacaagtacaaagattctcgtgaacaatttgaaatgcgtacacacaaacgtttgattgatatcgtaaatccgaccccgcaaacggttgattcgctgatgcggttggatctgccatccggcgttgacattgaaattaaactttaatgataaaacaaaacatgacatatttaacaggaggtgtgactgatgaccaaaggaatcttaggaagaaaaatcggtatgacccaagtttttgccgagaacggcgatcttattcctgtcactgtaattgaagcaacaccaaacgttgtgctgcaaaagaaaacagttgaaacggacggttatgaagcggttcagctcggatttgcagacaaaccggaacgcctggcaaacaaaccggaaaagggtcatgtttcgaaagccaatacggcacctaagcgcttcatccgcgaattcagcggcgtaaacacaagtgattttgaagttggtcaagaagtcaaagtagatatttttgcagaaggtgacattgtagatgttaccggcattacaaaagggaaaggattccaaggcgtcattaaacgccacggacaatcccgcggccctatggctcacggttcgcgttaccaccgccgtccgggttcaatgggcccgattgcgccaaaccgcgtctttaaacaaaaagcactccctggacgcatggggggagaacgggttaccgttcaaaatctgcaaatcgtcaaagtggatgcagaacgcaatctgcttttgattaaaggtaacgttcctggtccgagaaaagctttggttacagttaaagcagctgtaaaagcaaaataattgtaaagaaaggaggaaacaggaatgccaaaagtagctctatacaaccaaaacggttcccaagtcggtgaagtggaattaaacgacgctgtattcggcatcgaaccgaatgaacatgttttatttgaagcgatcatcatgcagagggcatcgctccgccaaggtactcacaaagtaaaaggccgttctgaagtacgcggcggcggacgtaaaccatggcggcaaaaaggtacaggacgcgcacgccaaggatcgattcgtgccccgcaatggcgcggaggcggtacggttttcgggcctgttccacgcagctacagctacaaattgccgaaaaaagtacgtcgtcttgcgattaaatccgctttatcgtcaaaagcacaagaaaacaatatcttggttctggacgcattaaactttgataagccaaaaacaaaagattttattgcggtcctgaaaaatttgtccgtggataaaaaagcacttgttgtcacagacggattgaacgaaaatgtggtattatccgcacgcaacattccgggtgttacggttgttgaagcagcaggcgtaaatgttttggatgttgtgaaccatgatcaattgatcatgacaaaatccgctgttgaaaaagtagaggaggtgcttggttaatggatgcacgtgatgttctgaagcgccccgtgattactgaacgttcaatggaattgacggcagataagaaatatacatttgaagttgatgtcaaagcgaataaaacagaaatcaaagatgctgtagaagaaattttcggcgtcaaagttgcgaaagtgaatgttgcgaactataaaggcaagctcaaacgcatgggccgttataccggctatacaaacaagcgccgcaaagcagttgttacgctaacacctgacagcaaagaaattgaaatctttgaggtctaaatacgatccatcaaacttgaagaggagggaaaaaaatggcgatcaaaaaatacaaaccaacctctaacgggcgtcgcggcatgacggctttggattttgcggagattacgacggataagcctgaaaaatcactgcttgctccgctttcgaaaaaagcaggccgcaacaaccaggggaaattaactgttcgtcatcagggcggtggccataagcgccagtaccggattatcgacttcaaacgcgataaagatggtataccagggcgcgttgccacaatcgagtatgacccgaaccgctcatctaatattgctttgattcactatgcagacggtgaaaaacggtacattcttgcaccaaaaaatctaactgtcggcatggaaattatgtccggaccggatgcagacattaaagtcgggaatgcacttccgctttctgacattcctgttggtacggtcattcataacatcgaattgaaaccaggcaaaggcggccaattgatccgttctgccggtacttccgcacaagtgcttggtaaagaaggaaaatatgtgcttgtccgcctgaattccggcgaagtgcgcatgattcttgcaacttgccgcgcaacggtcggtcaggttggcaacgaacagcatgaactggtcaacatcggtaaagcaggccgcaagcgctggatgggtgtacgcccgactgtccgcggatctgttatgaacccgaatgatcacccgcacggtggtggtgaaggtaaagcaccaatcggacgcaaatcaccaatgtcaccatggggcaaaccgacacttggttacaaaacgcgcaagaagaaaaacacttcagataaatttattgtacggcgccgtaaaaaataatgctgttgaactacggttcgcagcctgaaccgtagctctaatcaggaaggaggactattcatgggtcgcagtctgaaaaaagggcctttcgttgacgatcacttaatggtgaaagtggaaaaattgaacgagtccaacaagaagcaagtgatcaaaacgtggtcacgccgttcgacgattttccctgcatttgtcggccacacaatcgctgtctatgacggccgtaaacatgttccggtatacatcacggaagatatggtcggccataagctcggtgagtttgctccgacacgcacattcaaaggtcacgccggtgacgataagaagacaagacgctaacgggaggaggtattccaatgcaagcaaaagctgtcgcgaaaacagtccgtattgctcctcgtaaggcacgcctggtaattgatttaattcgaggaaagcaagtaggagaagcgctttcgattttgaaatttacgcctaaagctgcttcgccggttattgaaaaagtactcaactctgcgattgcgaacgcagaacacaactacgatatggacgcaaatgaccttgttgtggaaaaggcttatgtcgatgaagggcctacattgaaacgtttccggccgcgtgcaatgggacgcgcaagccagatcaacaaacgcacgagccatattacgattgtagtatcagatcaaaaggagggataattggtgggtcaaaaagtaaatcctatcggtttgcgaatcggagtgattcgtgactgggaatcgaaatggtacgcagaaaaagattacgccgatctattgcacgaagacattaaaattcgtgaatatatcgcaaagcgccttgcggatgcttctgtttctggcgtggaaattgaacgtgctgcaaaccgtgtcaacattacaatccgtacggcaaaaccgggcatggtgatcggtaaaggcggttcggaagtagaagcattgcgtaaagcgctgaatgctttaacaggaaaaagagtccacattaacattgtcgaagttaaaaaagcagatattgatgcaaaacttgttgcggaaaacattgcccgccagctggaaaaccgcgtttctttccgccgtgcgcaaaagcaggcgattcaacgcgccatgcgtgccggtgcaaaaggaatccggacgcaggtttcaggacgtttgggcggtgcggatattgcccgtgcagaacattacagcgaaggtacagttccgcttcatacgcttcgtgcggatattgactatgcacatgctgaagcagatacaacttacggaaaactgggcgtaaaagtttggatttaccgtggggaaatccttcctgctaagaaaaaaaccgaggaagggggaaactgatcatgttgatgcctaaacgtgtaaaataccgccgtgaacaccgcggaaaaatgcgcggccgtgcaaaaggcggcactgaagttgcatttggcgaatatggtttgcaggctttggaagcttcctggattacaaaccgccaaatcgaagctgcccgtattgcgatgacacgttatatgaaacgtggcggtaaagtatggataaaaattttccctcataaaccatatacagcaaaaccgcttgaagtccggatgggttccggtaaaggtgcgcctgagggctgggtggctgttgtgaaaccgggcaagattttgtttgaaattgccggtgttcctgaagaagttgcacgcgaagctttacgccttgcgtcccacaagctgccgattaaatgcaagttcgtaaaacgtgaagaaattggtggtgaatctaatgaaagctaaagaaattcgtgacttaaccactgccgaaattgaacaaaaagtaaagtcgctgaaggaagagctgttcaaccttcgcttccagcttgcgactggacaattagagaacactgcccgcattcgtgaagttcgtaaatcgattgcccgcatgaaaaccgtcattcgtgaaagagaaattggaattaacaaccgataatgggaggaggttcgcgatacatgagtgaacgcaaccaacgcaaagtatacaccggccgtgtcgtatccgacaaaatggataaaaccgttactgttcttgtagaaacttacaaaaaacattctctgtacggcaaacgcgtaaaatactcgaaaaaattcaaggcacatgatgaaaataacgaagccaaagtcggcgatatcgtaagaatcatggaaacacgcccgttatctgctacaaaacgtttccgcctggtggaaatcgttgaaaaagcagtcattatctaatttgtatcagttcggatacggttgattccgaagggaggtaaacgaggatgatccaacaagaaacccgtttaaaagtagctgacaactcaggtgcacgtgaagttttaacgattaaagtattaggcggatccggccgaaaaattgcgaatatcggagatgtcatcgttgctacggtaaaacaagcaacacctggaggcgttgttaaaaaaggcgatgtggtgaaagctgttgtggtccgtacaaagagcggagtgcgccgcagcgatggttcttatatccgtttcgatgaaaatgcatgcgtcattatccgtgacgacaagagccctcgcggcacgcgtattttcgggccggttgcacgcgaactgcgcaacaacaatttcatgaaaatcgtatcactggctccggaagtactttaatcgatatagtttgtgacaatcaaggaggtgcgattgtaatgcatgtcaaaaaaggtgacaaggtaatggtgatctccggcaaagataaaggcaagaccgggacgatccttgcggtatatccgaaaaaaaaccgtgtgattgtggaaggcgtgaacgttgtcaaaaaacacgcaaaaccttcccaggcaaaccctcagggcggtattctcgacatggaagcgcccattcacgtgtcaaatgtgatgccgattgacccgaaaacaaatgagccgacacgtgtcggatatgaaataaggaacgacaaaaaagtgcgtgtagcaaaaaaatccggtgaagttctaagcgtgcttaaggaaattaagaaaaagcctgaagaagaagggaggtaagcgacatgaaccgcctaaaagaaaaatacgaaaaagaagttattcctgctttaacaagcaagtttcaatatacatccgttatgcaagtgcctaaagttgaaaagatcgtgatcaacatgggtgttggtgatgctgttcaaaacgcaaaaatgctcgacaatgcagtagaagaattaacattgatttccggccaaagaccggttgtgacaagagcgaaaaaatcaatcgcaggtttccgccttcgtgaagggatgccgattggcgcaaaagtaacgcttcgcggcgagcgcatgtacgaattcctcgataaactgatttcagtttcgcttccgcgtgtgcgcgacttccacggcgtatcgaaaaaatcgtttgacggccgcggaaactacacactcggcattaaagagcaactgatcttccctgaaattgattacgacaaagtcagcaaagtgcgcgggatggacatcgtcattgtcaccactgcgaacacggacgaagaatcacgtgaactgttaggcctgctcggaatgccattccaaaaataaagcggacgctaaaaagggaggcgaaaacgtggctaaaaaatcaatgattgcgaaacaaaaacgtgaaccgaagtataaagttcaggcttatacgcggtgcgaacgatgcggccggccgcattccgtcattcgtaaatttaaactttgccgtatttgtttccgcgaacttgcatataaaggtcaaattcctggcgtgaaaaaagccagctggtaaaacccgaatttgggaaggaggtaaaagaaatggtcatgactgatccgattgcagatttgcttacgcgtatccgtaatgcaaatacagtgcgtcatgaaaaattggaagtcccggcttccaagattaagagagagatcgccgagattttaaaacgtgaaggtttcgtgcgtgatgttgaatatatcgaggataacaaacaagggattatccggatcttcctgaaatacggcgcaaacaacgaacgcgtcattacagggatcaagcgtatcagcaaaccgggcctgcgcgtatacgcaaaagcaggtgaagtgccgaaagtgctgaacggacttggcatcgcaattgtttctacttctcagggcgttttaaccgacaaagaagcacggaaaaacaatgtcggcggagaaattttagcatacgtttggtaattatttgacgttgaacggaggtgtaaattatgtcacgtataggaaaaaaaccggttgaaattccatccggcgttacggtaaccattaacggagatacagttacggttaaagggcctaaaggtgagctgacccgcagcttcaaccctgatattaacattaccgtagaagacaatatcattcacgtaacacgcccttcagacagcaaaaaccaccgcgctttgcacggaacgacccgcgcactgctcgcaaacatggtggacggcgtgtcgaaaggcttcgaaaaatctttggaactggtcggggttggataccgcgcccaaaaacaaggcaaaaaactcgtattgaacgtcggctactcccatcctgttgaatttgaaccggaagaaggcctggaagtcgaagtgccttccaatacaaaaattgtcgtaaaaggcgtaagcaaagaacgcgtcggcgcatttgccgccaacattcgcgatgtccgtccgcctgaaccttataaaggcaaagggattcgttacgaaggcgaatatgtacgcagaaaagaaggtaaaaccggtaaataatgccgcctaggatgagaaaggagtgaattcgatgattacgaagccggataaaaatcaagtacgcaaaaaaaggcatgcacgcgtccgcgcaaaattaagcggaacggctgaacgtccgcgcctgaatatctatcgttccaacaaaaatatttatgcccaattgattgatgatgcgaatggcgtcacactcgtcagtgcttccacgctcgataaagagttgagccttgagtcaaccggcaatgcggaagctgcacaaaaggtgggcgaattgattgcaaagcgtgcaatggaaaaaggcatcaaagaagttgttttcgaccgcggcggatacctctatcatggccgtgtcaaagcgcttgccgatgcagctcgtgagaacggattacaattttaatcaaaaaggaggggaaattttatatgctacgtattgacccaaataaacttgagttagaagaacgtgttgttacgattaaccgcgttgccaaagtagtgaaagggggacgccgtttccgcttttccgcacttgtcgttgtcggcgaccggaatggccatgtcggatttgggaccggtaaagcgcaggaagtgccggatgcgattcgtaaagctgttgaagatgcgaagaaaaatcttgttgaggtaccgattgcgggtacaacaattccgcacgaagttgttggccacttcggtgcaggcaaaatcttgctgaaaccgggttcccctggtaccggtgttatcgccggcggccctgtccgtgcgatccttgaacttgcgggtattgcggatattacgtccaagtcgcttggttcaaacacaccgattaacatgatccgtgctacaatggacggcattaaacaattgaagcgtgcggatgaagttgcgaaactgcgcaataaatctgtcgaagaattattaggttaaggagggaacgctcatggcaaaattgaaaatcaccctcacccgcagtgtcatcggccgcccgcaggatcagcgcgaaacggtaaaagcgctcggcctgcgcaaagtcaaccagactgttgagaaagaagacaatgctgcaattcgcggcatgatcaataaagtgtcccatcttgtttccgtatcggaacaataattttcgattttaagataaggaggtgcaaccatgaaacttcatgaattaaaacctgcagaaggatcccgtaaaaaacgcaaccgtgtcggtcgtggtattggttccggcaacggaaaaacagccggcaaagggcacaaaggtcaaaacgctcgttccggcggcggtgtacgcctcggttttgaaggcggtcaaaccccgttgttccgccgtttgccaaaacgtggttttacgaacattaaccgtaaagagtatgccattgtgaaccttgacgttttaaaccgttttgaagacggcacggaagtaacgcctgcccttttattggaaacaggtgtgatcagcaaggaaaaatcgggtgtaaaagtgcttgcaaacggcaaacttgagaaaaaattgaccgtaaaagcacataaattctcctctgctgccaaagaagccatagaagctgccggcggtacagccgaggtgatttaatgttcaagacaatcgccaattttatgcgtgtgggtgagataagaaataaaattattttcaccctcctcatgctggtcgtattccgcataggggcctttattcctgttccttatgtggatgcttccgttttggatgcctccacccaaaacggtttagtcggttttctaaacacttttgggggcggtgcgctgaggaacttttccatttttgcaatgggcattatgccatatatcacatcttccattatcgtgcagctcttgcaaatggatgttgtgccgaagtttgccgagtgggcaaaacagggtgaagtggggcgtcgtaagctgaatgagtttacacgctattttacggttatcctggctttgattgaaggcttcggcatgtcatatggctttaataatttggcgcagggggcactgattacgaagtccggtttttggacgtatttgattatcgcacttacgctgacagccggcaccacatttttaatgtggctcggcgaacaaattacggccaaaggtgttggaaacgggatttccattttgattatggccggcatcatcgccgggattccgacagccatcaaccagatttacgcacagcaaattgaaaatgccggttcccagctgtttttgaagattgttttgctggcttttcttgcattaatcattctggccattgtggtcggagtcatctatttccagcaggcatcgagaaagataccggtccagtatgcccagcacatttccggcagggcaacaaccggcaggcaatcaacgcatttgcctttaaaggtcaatgccgccggggtcattccggttatctttgcgatttcgttcattattgcgccgcagacgatcgcttcgtttttcggttccagcagtgtggcgagcaccatccagtatatttttgattatacaaaaccggtcggagctttgatttatgtggcattgattatcgctttctcgtatttctatgcattcgtacaagtcaatccggagcagcttgccgacaatttaaaaaaacaaggcggctatattccggggattcgcccgggcaaaaacacacagcaatatgtcacttcggttttataccggctgacatttgtcggttcgatctttcttgctgtgattgccattctgcctgtcattttcacgaatgtcatcgggctcccggcttccgccagaatcggcggcacaagcctgctcgttgtgatcggggttgcgcttgaaacgatgctgcaactggaagcacagcttgttaaacgccattacagaggctttatcaaataaaaatggtttcgtttttttgagaccatgtcaggaataagggggctgtacgatgaatctagtgttaatgggccttcccggagccggtaaagggactcaagccgaaaaaatcattgataagtatgccattcctcacatttccaccggagacatgttccgggcggcaataaaggaagaaacggagctggggcttaaagccaagtcctttatggacaaaggcgaactggtccctgacgaagtaacgatcgggatcgtgcgcgaacggttaagcaaggatgactgcaaaaatggcttcctgcttgacggtttcccgcggacggttgcccaggcagaagctttggaaaatattttaagcagccttggcaaacagcttgactatgtcatcaatattgaggtggaccgggagattctgacagagcggctgaccggccggagaatctgtgaacattgcggtgcgacttaccatctcgtgtttaatccgccaaaaacggagggcgtttgcgacaaatgcggcggcccgctgtaccaacgggcggacgacaacgcagaaactgtcgggaaccggctcgatgtcaatataaaacaaacccggccgctactggacttttatgaggaaaaaggctatttgcggaatgtaaacggccagcaggatattcatcaagtttttgcggatatcgatcaattgctgagccaactgggttaaacgtgaacgacttggtgaattcatgagagccgcaatcacgttggatggaaaccacctttggaagttttaaccggccggcttttcggccatgtcctgacggtaaaaaacttttcaagtttgatgcaatttccgcttaaaaaggttataatggttttcgtggcattttcaccgctggatatttcacgggtgaaatgacggctctgttttattggcgatttgcttcatccgttaacttgtaatcaatagatgaggaaggcggcttccgttgtcaggattgccagtaagcgtcattcgaacgtctctcatgcaattcaattctgtgcaaatggctttcgttcgttcacatgtatgccggacatgggattggtcaagactgacatgaaagaaccatgtaaccttgggaacgtttatcagctcttgccggcccctcggatcagccggtttacgtgaatatgcagcaggccgaccgcttcctgaagagggagttttggcgagcctgatcgttttaaggttttggaaaagtatcattgccaggtcctaaatgttaggaggagggagaaaagttcgatggcgaaagatgacgttattgaagttgagggcattgtgagcgaaactttgccgaatgccatgtttaaggtagaattagaaaatggtcacactgttcttgcacatgtgtcgggaaaaatccggatgaactttatccgcattttgccgggtgataaagtaacagttgaactgtctccgtatgatttgacccgcggtagaattacgtaccgctttaaataatgtagatacacggctttttcggtgaaacggaaagtctgcctggggaatctgtttggaaaaaaggtaccgggcttgtactccgtatattaaggagggtaaaccatgaaagttagaccatctgtgaagccgatctgcgaaaaatgcaaggttatccgcagaaaaggcaaagtaatggtaatctgtgaaaatccgaaacacaaacaaaaacaaggataaatttgaaggaggtgcacctgtatggctcgtattgccggtgttgacattccacgtgataaacgtgttgttatttctttaacatacatttacggaattggtaaatcaactgcacaaaaaattcttgctgaggccggaatttctgaagatacacgcgtccgcgacttaacagaggatgaagtaaacaaaattcgtgacatcgtggacaggctgaaagtagaaggagaccttcgccgtgaagtttctctgaacattaaacgcctgatggaaatcggatcttacagaggtctccgccaccgccgcggtcttcctgttcgcgggcaaaacacaaaaaacaatgcccgtacacgcaaaggcccgcgtaaaacggttgccggtaagaagaaataataagcaaaggaggttgttcatatggcacgcagaacaaatacgcgtaaacgccgcgtaagaaagaatattgaatcaggagtcgctcatattcgttccacttttaacaatacaatcgttacgatcacggatgtgcatgggaatgctgttgcatggtccagtgccggtgcgctcggtttcaaaggttcccgtaaatcaacgccgtttgctgcacaaatggctgctgaaacagccgcgaaagcatcgatggaacatgggatgaagtctttggaagtaactgtaaaaggacctggtgcaggccgtgaagccgccatccgtgccctgcaggctgccgggcttgaagttacagccattaaagacgtaacacctgtgccgcataatggttgccgcccgccaaaacgtcgccgtgtctgattttttttgtatagattttgtatccttgtcaataatgggatatgatgcataatctgcaaaaaaaatgatttgaatgatccagttgttatgcataatagggaattttgcatggggaatttcgaatagggctctttctggggtgctatacggggtttcgacgttttgaaggagggttaatttgaatgatcgaaattgaaaagccaaaaattgaaacggttgaggtcagcgatgacgctacttatggcaagttcgtcatagaaccgcttgagcgtggatatggtactactttgggtaactccttacgtcgtatcctattatcctcactcccgggtgccgctgtcacttccatccaaatcgatggcgtgatgcacgaattctcgacagttgaaggcgttgttgaagatgtgaccagcattattttgaacctcaaaaagctggcattaaaaatctattccgatgaggaaaaaacgcttgagattgatgttcagggagaaggcgctgtgacagcagccgatattacgcatgacagcgatgtggagattttaaatccggatctctatattgcgacggttgccgaaaacgggcatttgcgtatgcgcatgaccgccaaccaaggccgcggctatgttcctgctgatcaaaataagcgggaagaccatccaattggtgtcattccaatagattctatttataccccggttcaacgcgtgaactaccaggtcgaaaatacccgggtagggcaaatcagcaattatgataagctctcactggatgtcacgactgacgggagcatcggcccgaaagaagcaattgctttgggcgccaaaattttaaccgagcatttgaacatcttcgtcggactgacagatgaagcacaaaatgcggaaattatggtggaaaaagaagaagaccagaaagaaaaagtgcttgaaatgacaattgaggaacttgatctttcagtccgttcttataactgcctgaaacgtgccggcatcaataccgttcaggaactggccaataaaacggaagaagatatgatgaaagtccggaatcttggccgcaagtcccttgaagaagtcaaagcaaagctcgaagatttgggcttaggtttgcgtaaagacgactgagccggttagaaggcaaagcgattaatccaacataagggagggaacttcatgccttacagaaagttaggacgcacaagcgcccaacgtaaagcattactgcgcgatttggcaacagaccttatcattaatgaacgtatcgaaacaactgaagcacgcgcaaaagaattacgctcagttgttgaaaaattagttacgcttggaaaacgcggtgatcttcatgcccgtcgccaggctgctgcatttgtacgccatgaaacagctgacgaagaaacaaaacaggatgctgttcaaaaattattctcggtcattgcagaacgttacgcggatcgccggggcggctacacccgcatcttgaaagtaggcccgcgccgcggagatggtgcaccggttgccattattgaattcgttgaaaaagaaaagcaagatcagaatcaagagcaagatcaagagcaagtaaacgaatgattttcttgagggctggacagttgaaaggttcttaactgcttctttgccctttttctatcttttttcggtttgtaatcgcagactttgcagcgctgggatggtctgtacttgcgaaaccctttcgtttatgtgtgatgcaataaactgtgagtgttacgatgggcgcattttgtgcccgtctagctcttgcacccctttttatttctgtgcgccggattgttaacgtctacactgaagaggggtgcaggcttttttattatggggatattttacccgccaaactgcacgacaatacggtaaaatataaatacaagcaaacgggcgaaacattggttatcatcgttcggaagagaagccgtttgtaaacgggctgttgctgacgcgtggcgaggcgcataaaggctgggtaaacacccaagcaactttgcggtgccgccatcaggatggaaatgaagttgaagagaatagcgaaggattgcttagcatgttttaaccgtgctaaaaagcaggttacagaggaggaatccggcattggcagacagcacgaacgtgatcattgacatcgaccaggtttccttccgttacccggaacaggaaacgtatgcactaacaaatatttcttttcaagtttataaaggcgagtggctggccattgtcgggcataacggatccggaaagtctacgctggcgaggctcttaaacggcttgcagtttcccggaaagggcacgataacggtttccggcctcaagttgtcggatgaaaatgtctgggagatcagaaggcgcgtcggcatggtgtttcaaaatcccgacaaccagtttgtcggtacaaccgttcaggatgatgtcgcattcgggctggaaaatcacggtgtgccgcgtgaggaaatggtgaaacgcgtccatgatgccttaaagcgggtgcggatgtcggactttctggaccgcgaaccgcaccatttatcaggcgggcaaaaacaacgggtggcgatcgccgggatcatcgcgctaaagccggaagtgatcattttggatgaagccacgtccatgctcgatccggtcggccgcaaagaagtgctggagacgattcgacagctgaaacaagaagcagggctgaccgtcatttcgattacccatgatcttgaagaagctgcccaggcggaacggatgatcgtgatgaaccgcggcgaggtctaccgggaaggcacaccgcgtgacatttttcaaatggatgagacattgactgcgcttggccttgatattccgttcccggtcaaaatggcaaaagcgctaaaagcaaggggcttggacttaccggaaatttatttaacagatgaagaattggtggatgcactatggacattgcatttgaacaagtagaataccggtatcagccgaatacgccgtttgaaaggcttgcactctatgacatttccctcgccatcccgtccggccgctatatcgccgtgatcgggcataccggctcaggtaaatcgacgctgctgcagcatttgaatgccctgcttcagccgacaaaaggaaaagtaacaatcggcagccgggtgattgaagccggaaaaaaggaaaaaaacttgaaggcgatccggcaaaaagtcgggattgtgttccagtttcctgaacaccagctgtttgaagaaacggtggaaaaagacatctgtttcggcccgaagaatttcggcgttccggaaaaagaagcgaaacagcgggcgagggagctcatccggcttgtcgggctttcagaagagattcttgcaaaatcgccgtttgacctgtcaggcgggcaaatgcggcgagttgccatcgctggtgtgcttgcgatggaaccggacgtgcttgtgctggacgagccgactgccgggcttgatccgcgcgggcgccacgagatgatgggcatgttttacgaattgcaccagaagaagcatttaacgactgtgcttgttacccacagcatggaagatgccgccctatatgccgatgaactcgtcattttgcatcaggggaaattgatgaaaaaaggcgcaccccgtgacatcttttccgatcctggattgcttgaaaaatggggattaagcgtgccggagattgtccgcttccagacgatgctcgaggaaaaaaccggtatgaagttcaataagacatgcctgacagtggaagaacttgcggaagcattgcaatcggttttgaaacggggtgggcgcgtatgatggaaaaaatgattttcgggcgctatattccgggcgattccgtcattcaccggatggatccacgttcaaaattgatttttgtatttgtctttatttgtattgtatttttggccaataatgcggtcacctacgggattctggtaatctttaccttgcttgtgatgctggtttcaagagttcctgtccgcttttttattaaagggttattgccgattttatggctggtcatttttactttttttctgcagctatttttcaatcgcgagggcagccttgttttccattatgcatttattcatatttatagtgaagggatccggcagggtgtgtttatttcgctcaggtttatgctgctgatctttttaacatcgcttttgacgctgacgacaacgccgatttcgctgacagacgggattgaaatgctgcttgcgccgctccggaaagtaaaatttccggtccatgaactggcattaatgatgtccatttccctgcggtttattccgacattaatggacgagacggaaaaaatcatgaaggcgcagatggcccggggtgtcgatttttccggcgggagtataaaagaccgggtgaaagccattattcctctattaattccgctgtttgtcagttcgttcaaacgtgcggaagagctggcaacggcaatggaggcccggggttaccagggcggggaggggcggacgaaataccgcctgctcgtctggcgtacggctgatacgctgtccatttgtgcgctggccgtcgttattgtcctgctcgtgctgttccgtgacggggggattttatgaagcgcgtaaaatgtacggtcagttacgatggttcccgattcgcggggtaccaggtccagccggggcagcggacggtccagcaggaaattgaaaaggcgctggccactcttcataaaggccgccacgtgaaaacggcggcttccggaaggacggatgccggcgtgcacgcgatggggcaggtgatccatttcgatacggatctttctattccggaaacaagctggccggccgctttaaacagcctgcttccaggcgatatttcggtctcgaaagcggcatatgcggaccctgcttttcacgcccgctactcggtaaaagagaaggaataccgctaccggatctatttttctcatgtccgcagtccgtttaagcaccgttacgcgttaagggtctggtattcgcttgatatcgaggcgatggaagcagcagctgagaccgtgctcggcacccatgattttacgagtttttgttcagcgaaaacagaggtggaagacaagattcgtacgttaaaagagattcggtttttgcagcaggacgatgaattggtgatctgttttaaaggaaacggctttttatacaatatggtgcggatcttaaccggcactttgcttgaaatcggcagcggcaagcgcgagcccggtgaaatgcgcgaaatccttgaaaaacgcaaccggatctatgcgggcaaaaccgcgccgccggaaggattgtatttatggaaagtaacttattgacggggcatggatccgcatgataaaaagaagataaaaacaaccggaccaggcgtaacatttgcttgacattcttgccccaaaacgatattataacctatggtattgtttttttaactccacgataagccccggaaacttattgtgataatgacaatagatcatgactgtgtttttgtgaatattttttaggagggtaactcatgcgtacgacttatatggcaaaagcaaacgacgttgaacgtaaatggtacgtagtggatgctgaaggcaagacccttgggcgcctcgcttctgaagtggcatccattttacgcggcaaacataaaccggttttcacaccgcacgtggatacgggcgaccatgtgatcatcctgaatgcttctaaagtagaattgacaggcaaaaaactggaagacaaaatttactaccgccacagccagtttgcaggcggtttgaaacagcgcacagcaggcgaaatgcgtgcgaactatccggaaaaaatgctggaacttgctattaaaggcatgcttccgaaaggttcccttggacgccagatgtttaaaaagttgcatgtgtatgctggcgcagagcatccgcatgaagcacaaaaaccggaagtttacgaacttcgcggataattttaaaaggagggcattattttggcacaagtacaatacgccgggaccggacgccgcaaaagttctgttgcacgtgtccgcttagttcctggaaacggcaatattacggttaacgggcgcgatgtaaaagattacattccgttcgaagctttagttgaagtgattaaacaaccattgaatataacagaaacaaacggcagctacgatgttctcgtaaacgtaagaggcggcggtttcacaggccaagctggcgcaatccgccacggtattgcccgcgcattgctgcaggctgatcctgaatatcgtgcagtgttaaaacgcgcaggccttctgacacgtgacgcccgtatgaaagaacggaagaaatacggtctcaaaggcgcacggagagctccgcagttctcgaagcgttaataaaccttatacaccaaggttttgccctctatactcttatgagtagggagggctttttcatgtccaaatttgggattgaataccccttgaataccccgagctaaaatttcatgtacttctggtatatctaggttgttttctccttcgcttcatccgtcacatgagtgtaaatatccatcgtggtttgaacatctgtatgtccgagccgggcttgtacatctttgatggcaacaccagcagcaaacaacaaactggcatgggtatgccggaccgggttctttagataaatcctctctatataaggtaaacttaagtttttgacagctctaatctaacaagcagccagttaatgacttcctggcttttttggctggcttgtttcataaattccgccacgtgggagcgaatttggtaaaatttgctgaaaaagtcgttgtttacgacatcttgctttagccacttccataatccttccactgggttcaactctgggctgtatttaggaagaaaaacaaattccattcgcggattttctttcaggaaatccttgataaattgtgattgatgcactttgctgttgtccaaaaccattacaattttaccatgcgagtatttacttaaaatgaaatgagttctacaaaacgtctaaaggccaaggaattgcttttttcttcttcataatgcgtaatttcgccggtttcatagtttatggcagcgaacaacttgcacccttatgctggccgtatgtttttaatgattagcctcctactcgattggcaccagttccttgatctccttcccgtccacaaaggaaggcgaaggcacattcatcatccggtaaagcgtcggggcaatgtcgattaaagaaagccggcgcgatacctttttatgcggaatgtcctttccgtatgcaagcagaaccgggcgcagatcactcctttccgggttgccaccgtggtttctaagttcggacggggcatggaaagaggaagagatgtccgaatccatcatgtaacctctcgctgcgacaagcgtcacatcaccggcatgcgggtggtgaaaccactcactttttttgctttgcgctttgatcacggactcgtacggccgggccgtgtcattttttaccgtatcatacagggacgataccgtttctttcgtagtggaccagctgctgtgcccgtttgttatgcctgcccaccagtccgaaagatagaaacccgccagtttagattttgaagcaaggatgcgcggatcgcgaacagacgaaaaaatttttgccacctcctgctgcacattcccgtaatcttgcttagaaacaattccgcctttctcccttcctttcaaattgatgtagacatgggccatcgtgccggaagcaactgcatacgcttttgtacggtccaaatcaacttctccgtttttctttaaaacaagcagaccgtgttttttcagctcgtaattcggagagagcccggtgtgcatcggttccatgccgtggtccgacacaacaaacaatttgtcattttctccgagtgactgcaatgtttttccaactgtatggtcggccaattgatacgcccaacggatccgggccgcatatgtttttgcttttttatcggaatagccgggctggcgcgggtctgttaacaaatatgcatgttcttcatggtcgatttgcggctcataaaacatgagcagatccggtttatagcgatccttaatgaatagagagacattttgcacccatcgggcaaagcgggtggagatgtcttcatattctgtccgggtaatccagccttttttgaaggcgtccaatgtaatgtctttggcatcaaatccatgcttcataattttgtttaaatgcggcagttcctttttatgttcgtggacataatcgtttttcatgccgtcaaaagacacgacaacaatggtccctttttcagatgcagccaggggtcggcccggaacaagcgcacaaaggagggcggccggcaggatgtactgaagcaaacggctgaatcgtttcatggaccttccttcctttcttatatgtactgtcagcattctattttcccttgatggctgcaggtaaacaaagcgcggaaacagggaagctaaggcactggctaacttgttcatcattttttaagcatcttcataatggaattgcgatctccgccagcggcaacttaggacccattctccatccgaacttacggattaaagcggatcattgtttcacacgaagaacggtttgatcatacacttgattgtcactttaaattgccggcacctttcatttgccatagctggaagacgaaacgaagctgaggcagaaaatcaatcttttcttcccccggtactgccaacaagccttgatgattttatgcagcgtgaagacatcgctgaggatgtaaaggcattatacttgcttgcccttgaaggaacaaaatcgcaggaagtctttcagtccagggcatatcatgagcggtcgagaagctataccaggattatttaaatgattacggcgagctgtaccgtgatccgccaagatctgcaaaaaaataaatgcaaaaataatctgtttaatgctaaaataaatattacggaagtattccaattgtttttataggaaaaatgcaaacgagtggaggaaattggaacatggctttttcaacgagcatcccgcacggcggtatattggtaaaccgggaaaaccacagtgcggaagctttaaaacaggcagaacaattaccggcattaaccgtttccgactggagcatctccgacctggaactgatcggtatcggcggcttcagcccgctgaccgggtttatggggaagcaggattatgaaacggttgtggaaaatatgcggctttcaaacggccttatctggagtattccgatcacgcttcccgtaacagaagaggaagcggaaaggtttgaaaccggcgaaacgctcgcattaaaaggtgcagacggcgtgatctacggcacgctcacactggaagaaaagtatacagtggacaaagaacgggaagcaaggctcgtgtacgggacaaccgacccggcgcaccccggcgttaaacgcttatatgaaaacggggatgtgtatcttgcagggccggttacgcttttaaaccgcccgaatcatgacgagtttgccgcttattataaagatccgaaagaaacaagggcattgttcgcatccctcggctggaaaacgattgtcggcttccagacgcgcaacccggtccaccgcgcccatgaatacattcagaaaagcgcgcttgaaatcgttgacgggctgcttttaaacccgcttgtcggcgagacaaaaagcgatgatattccggcggatatccggatggaaagttacgaagtgattttgaaacattattatccaaaagatcgtgtgcgccttgttatttaccctgccgccatgcgctatgcaggcccgcgggaagcaatcctgcatgcgctcgtccgtaaaaattacggctgcacccatttcattgtcggccgggaccatgccggtgtcggcgattattatgggacgtatgaagcacaggaactgatcagcactgtggagcaggaactgggcatcaccattttaaaatttgagcatgcgttttactgcacgaaatgcggcaatatggccacaacgaaaacctgtccgcacggaaaagaagaccatattcatttgagcgggacaaaagtgcgcgaaatgctgcgcgtcggccaaaaaccgccgaaagaattttcccggccggaagtggcagaagtgctgatcaaagggatgaaagtgcacaattaaacgtccacaaatcacaaggagggaaccggccgcatggcgaaagcaaccaatatcacatggcatgaaaccaaaattaaaaaggaagaccgccggaggttaaacgggcactccagcgcagtcctctggtttaccgggttatccggtgcggggaaatccacgctgtccgtcgccgttgaacaggaactccacaggcgggggatccgcacgtatatccttgatggcgataatatccgccacgggttgaataaaaatctcgggttttccccggaagaccggaaagaaaatatccgccgcatcggagaggtgtcaaaactgttcgtggatgccggcgtaatggtgctgacggcgttcatttcaccgtaccgtgctgacagggacatggtgcgcgaactggtcgaagacaatgaattcgtagagatttacgtgaattgcccgctggaagcatgtgaacagcgggacccgaaaggcttatacaaaaaagcccgcaatggggaaatacaaaattttaccggtatagatgccccttatgaagccccggaacatccggaacttgtcgtggaaaccgacaaacagccgctggaacagtctgtcgggcaggtgatccgctttttggaagaaaaagggtacatcgaaaagtagccggttttataaacggcaaacgtgcagcaggtgcaagaccttgctgcacgtttttctacatagggatgtaagattatgcaacaaaatgctggaaatatgcaaaatcctgttttcatccggaattttttgtgctatggtatggacgttgtgatttattttaaccagatgcgtatgatagataaatggagatgaacatacgatggcaacacaaaaatccggcctgaaacggcgtttaaaggcgcggcatctgaccatgatatcactcggcggctcgatcgggaccgggctttttctcggaagcggcgccgcgatttaccaggcgggcccggggggagcgctgcttgcctatttggttatcggtgtgatggtctattttattatgacaagcctcggggaactggcttcatttatgccgacaagcggggcattcagtacgtatgcaacccgctttattgatccggcgctcggttttgcgctcggctggaattactggtacagctgggccatttgtcttgcagcggaactgtcggcatcgacgctggtcatgaaattttggtttccgcacagccccagctggttgtggagcggcctgtttttgctcgtgatttttcttttgaacattttgtccgtgagaggctatggcgaaggagagtactggttttcctttgtcaaagtggcgaccattatcctttttattgttaccggctttttgatgatatttggcatattgggcggggcaccggccggctttaaaaactttacaatcggggatgcgcctttccacggtggtgcgcttgccgtgcttggcgtgttcattacagccggattttcattccaggggacggaaattgtcggcgttgcagccggggaaagcgagaatccgcgcaaaaacgtgccgaaagcaatcaaaagcattttctggcgcattttgttgttttatgtccttgcaattcttgtcatcgggctgattatcccttatacgacaaaaagtttgcaaagtacggatgtaatggtgagcccgtttacgcttgtctttaaaaaagcggggcttgcatttgctgcatccctgatgaatgcggtcattttaacggctgtgctgtcggcgggaaactcgagcctgtatgcttccacaaggattttgtatgcaatggcccatgaaggccaggcgccgaagtttttcggcaaactgaacaaacgcggtgtgccggtcgcagcccttgttgccacggccattgtcggcgcgcttgcatttctcgcatccgcattcggggacggcgccatttatatctggctgttgaatgcagcgggcgtcacgggctttattttctggctcgggattgccgccagccattaccgtttccggaaagcgtatctcgcccagggacgttcacttgacgatctcccttaccatgcgaaatggtacccgttcggcccgatttttgcgctgattgtcggcgtgatcgttattcttgcgcaggattatcaggcattcctcggcggccgtatcgactggatgagcgccattgccgcgtatctcggcatcccgctttttgccatcatgtggctcggctacaagctcgtaaagcggacaaaagtcatcccgcttgaggcatgccggattgatgaccggggatttgaccaggagccggagcatactgaaaaaaaggatgcgcgctcctgagcggtgtgttggcttaaagcgcgcgcccatgttgcgatatcgattccttgtttggaaatcattataaagtatcgacgcctctacgcccgcgtacaataccggtaaggagtgggtagagatgaatgaagtcattaccaccctgtctgcgaaaagacgggagaggcaaatgaaggcggaacgcaatttgctccgcgaactgccggttgaagtgctgaagaaaagcttccagtcccatttcggttcgttccggatcaacgggggagcgtggatggagcaggggatcgaagaagggtgttacgatgtcgccattgaagcctatttattgggcggccattacagccggttcgggtattacggcgagccggccgagcaggcaaagaaacggtgcgaaaccgaattaaagcatattacagatactctgtacaatttttggctttattggacattcggcaatgatacgatgcaggagtccatttactatacatgcgagcagtttgccgactacttttggtcttacggctttaaaaaaggcgaacaaaggcggaaactgcggcttcattaggggatgcccgttttgcggctcccttttttgcagttctattttcctcccttgtcccataacttttcaataaggacagggagagggagattgtgatgaaacggaaaatcaaaattgcggggtttctgcttggtgtcacccttttatttttacttgtgcagtttgagtttttccaaaaagatacgtggcgcccgtggaatctgccgctttccgggaaaatcatctatctggatccggggcacggggggccggacggcggggcaacgggagatgaagtgctggaaaaagatgttgccttaagtgtggcggccaaaatcaaagactatcttcagcagcagggcgcgcttgttattatgacgcgcgaaacggatacagaccttgctgataacgagacaaagggctacagccgccgcaaagtggaggatttaagaaaaaggctttccctgatcaacgagtcggaagcggacctttttatcagcatccatctgaacgctattccgcaatcgcagtggcacggcgcccagactttttacgccccgactatgattgaaaataaaaggatcgccacgtttatccaggcggagctggtccggaatctcgaaaatacaaaccgggcttccaaaacattgtccaatgtgtatttgctgaagcatgcgaaaaaaccgggctgccttgtggaaatcgggtttttgtccaatcccggggagcgggagcaattaaaatccgatgcgtaccagacaaaggtggcggcatccatttatgaagggattatgcgctactttacaaaagaaaaggacttaaagaactgacaagcatccggagccgttccagcgcaaaacactgccattgtatggtatactggaatcaagctggaaacgacttcattttaaggatggtgtagaaaatgttgacggaacaacaggtttacgacgtgttaaaagggtttgaagatccttttttacataaaacgctggaagaaacaaaagggatcctcgaaatcaaaatcaaagaagagatccagcatgtcagtgtcaaagtagcgattgccaaaactggtacaagcgaacagctgcagctgcagatggccattgtgaaagcattgaaggggattggcgcgaatacagtcggcatccgtttcggcgaactgccgaaagaaacgctcgaccggttccgcgatttgttgcaggaagacaacaaaaacccgctcggctccgccaaaacggaatttatcgccattgcaagcggcaagggcggcgttgggaaatcgaccgtttccgtcaatttggcggttgcactcgcccgccttgggaaaaaggtcggcctgattgatgccgatatttacggattcagcgtgccggacatgatgggcattatgcagcgtccggttgtccgcggagaaagaattatcccggtggaacggttcggggtcaaggtcatttcgatgggcttttttgtagaagacaatgcgccggtgatctggcgcgggccgatgcttggcaaaatgctgaacaatttcttccatgaagtggaatggggcaacctcgattatttgctgcttgacttgccgccgggcaccggggatgtggcgctcgatatccattcgatgctgccgcgctgcaatgagattatcgtgacaaccccgcatccgactgcggctttcgttgcggcacgggccggcgcgatggcactccggacggaacacaatttgctcggtgtcattgaaaatatggcttattttgaaagcaaggtgaccggcgaacgcgagtatgtatttggtcgcggcggcggggaaaaacttgccgaagaattgcggaccgaagtgctcggtcagctcccgcttcagcagccggactggaatgaacatgatttcgcgccgtccatctatgccgaagaccaccggctcggaaaaatttatacggaaatcgcacaaaaaattgtggacaagctgaaaaaataaatgtggaaagcggcggagccaaatcccgccgctactttttgtctttcatcgttttcgccgctttcagcagactgtcttccattttcgctttaaaagccgggtcattaaacgtatcgatgacaacctcctgcatggttttccgcatttctttgctctttagcatcgtttgcacttctttttcgtaagccgggtcttttaaaatatccatcatcattgcctggtaatccggatccttcatcaaacttttcaacagcgctttgttttcagttttcatgctgtctgcaaccgcggcggcaaatttcggatcctgcatggcttctctccaaaaagccttgcctttatcggaagttaatgtttgttcgatcgcttctttcatgtacgccttgtcaatgaccagattctttttcattccgtcgcttgtaatcacgtcctgcagcgctttttttccttcatcggttttcaatatgtcaatgaccatttttttcgtctggttataatccgcttgcccgcctgttgaagcctcgcccgagcaggctgtaagggcagcgcaaaggctgatcaggagcaaaacggttcttggtttcatgcttttggctcccttcttcattctatctttaatatgtgaagttcttttcggattatgcgctcggcggggaggcttaaaagcactggaattttttcccgggaccggagcctgatcgtgctacagctctgcaaaaaccggcttcatcgtgcggattggtaaaacagtacagttgggaaagccggcatgatgtgctggatttttctcatgattctctgttacaataaaggtactttaaaggcaaagggggatggggattgacaagccggaactgggttcgtttcttttttgccgctcttgccatcggaggggtgtcagccgggattctcgggtttttcgtccgctggccggaaatggcgccttattttgcacatgcggatcttttgtccatcgctggcgcgtttttctggtttgcggggttgggcttgattttcagtcttgtcagtcaggtaggtttcttcgcctggttaaccgtgcaccagctcgggcttgacattttccgttcgcggcttgtttggcaggccattcagcttgttgcagcctgttatgtactgttcgattttgtgtacttccgcgcggatacccgccagtccctgctgtttgcagcactgatccttgtgtccgcgtttgtggcggcagctgctaagacgaagcaggcaaaaagtgcaggggcttttattcctgccttgtttttcatggtggcagtgaccattctcgagtgggtgccagctttgcgtgtcaatagcatatcctcgctttatcttatgcttttcccgcttctcatctgcaatgcttaccagctgcttgtgcttccacattttttaaagcgctcccaaaaggaaaaagaggaaaaagcagcattgcgcaagatcgcagaagaaaagacggcaaactaaaaccggagcctgatggggtatccggtttttgctgtttgggcagtaaatgcataaaaattttctcagctggcaatagacacgataacagtgggaacgcttgaaacgcccgcggcccatgaaaaaaagcaatagaagagtccatggcttctgctccatacgacacagagcaccggatgattccatttttgcaaccgcagcatttttccggtaaaggatgccgcggccggaatccatggttcatgaccgcggtttcgatcatttttgaaaccagtcggcccctttgtccatatggaggaaggggatatccgtatccacttcgccggtgatcttttcaatgggcaagtcttctcctgacagccatttggcaaagtcaattttcaccggctcgcagtcaccgcctaaagcgaaccaggcttccatttgctttggcaggtaagcggaagtatggattgtgcccgcccagctagcgtatagttctgaaaaaacgcctttatcccggctatttaataattgaaacgcgtcccgggcgctggatagatgccctttttcctgttccaaaatggcggttctgcgcatcgaatcgctgagatgatgccggttttctttgctgagggtttcaaaatgattggtgcaaatatctccgttccgcacggcgaccgcgcgcggagaggcttcgacaatccgggtttccccgcttttatcataaacgacatagctgaatgaatggcggtgcggaatttcttttaacatggcaacggcttcgtcaatatttacgcatgattccagtagcagcctgccaatcatgcagcaaataaacccgtcgccgggactttttcgatggataaacgtatagccgatggcgagccctttttcattcatgccgtccatccgcccggtgacgcgctggctcggcccggcaatcgcgtacccctggtcggttggctggtacaggacatagcgtccttcataggttttaggatggtaatcatagttgcggatgagatagccatcgcctgttaaaatcgagcagcctgattttgtgtaatccacccggtagccgccaaattcctgcaaaactttttccatcggccatttcagtgcttcctgcaatccgcacaactcgtcccagattccgggtgcaaagcgggtgattgcgtctttcgtttcgttaaggtcgattacaaaccgcggttttctgactttccattgattgtcgcggttttggatggaaagggattcttttaatgcaagcccctgcatataaccgaatttttcatgtgacccgcgaaattggaccactgtgctgaaaatttgcttcattattccattcacctgcaagcccatttggatatcctttcatatcattcattttaacacattgtatttctcttctcctaacaacgatataccaagtgggcctgtggctttaaggaatcactttcgtttctgctttgccgtttgcaatcatttcggaaacggtcacaaattttcctttatccgacaagtggcggatgatttgcggcagggctttgttcgtctgctttgcggcatcagaagcgtgcagcaggatgatatccccgttttcggctgtgcttgctttttcaataatttttgcggtgcccgggtttttccagtcatcggtgttgacgctccagtgaaccattgtaagccccagttggtccgcaatttttaatgccgttttgtcaaaatggccggtcggggaacgcaaaagttttacatcctttatttcaagttttttaaacacttcttgtgccttctgcatatcatgccgcactttagccggttcttcatccgtgtaatccacataggcataaccgaggcttccgatctcatatccggctttttcaatcctattcacaatatccgggtgctgttccgcccacgcgcctgacaggaaaaaggttgcggactttacgccgtttttctgcagcgttttcaagatagggacggctttttcatcgccccagccaatattaaaagttaacgcaatgccgttttctcctttaaaaacggctttcggggtgccttttgctgaaaaagctgccgtctgcgccagtgtttgggtatagatcaataaggcagtaaaaaacgagacaatgacaatgaaaagatacggtttccagtttcgcgatttcgtatggtgcatgattcaacctcccgttaaaaactgcacttgtcttattgtatgcgccattttttcaggattatgcaaggaaaagtgctgtgatattttccttaaatttggtaaaaatagacgtaccatgaacagaaagggtgcatgcgggtgttaggtcttgtcgtccatgaaaaagagctgctggaactgcagtatttgttgaaaagagaaatggaagaaattttacttgacctgaatgatgagcggattgagcgggtcatcaaaagggccatgaaagaacggtaccggattctttttaagctcctgacaaaagtcgcgccccaaagcgaatatgcccaattcgccgtgtcctataggcgggaaatgaaacagtaaagagcggaggcagccgctcttttttttacggtcttttggaaaagaagaagcgaagagcgttctggaaaaagggaaatcacggaccttgaccggaaagaaggacgcgagttgtcccggccgcccgggtgagccgcacccttttgatcactctttcacaaaaagtcaataggcctggaagaataattttccagaaaaataatttgtcaaataatattcgacagtttttaaccgaattgtcacatggctcctatctgtaccataaaaagattaaatataatataagtgtaatgataaagtaacggaaatatggaagaggaggggattttgggaaatgagtgaagtcatattggcacggacccagtttgcaacgacaaccttgttccacttcattttcgtgccgctttcaatcggattggcatttattgtcgctgtcatgcaaacgctttacatggtgaaaaagaaagaaatttacaagaaaatgacgaagttttggggaacctttttcctcatcaacttcgcagtcggagtggtgaccgggattatccaggaattccaattcgggatgaactggtcgacctactcgcggttcgtcggggacgtattcggcgcaccgcttgcgattgaagcgctgcttgcgttctttatggagtcgactttcatcggcctatggattttcggttgggacagactcccgaaaaaactgcatctggcctgcatctggctcgtctcgatcggaacgatgctgtcggcgctctggattatggccgcaaactcgttcatgcaaaatccggtcggctatacgattcacaatggccgtgccgaaatgaacaattttgccgccgtgctgttgaaccaaaaattgcaggtggcttacccgcacattattttcggcagccttgccaccggtgcgtttttcatcgccggcgtttcggcctggaatttgatcaggaaaaaagaagtggcctttttcaaacggtctgttgccatcgcacttatcgttggtcttctcagcgggctcggccttgccttttccgggcacagccaggcacgttatctcattaatgtccagccgatgaaaatggctgctgcggaaggcatctggcaaaacaccggggaccctgcgccgtggacattgtttagtgtcattgatacgaaaaataaaaagtcggaatacagggtgcaaattccgtacttgctgagctacttatcctatggcaaattttccggatctgtcaaagggatgaacgagctgcaaaaagaatacacacaaaaatacggggcaggcaattatattccgcctgtaaaaacaacgttttggagcttccggatcatggttgccaccggcggcattatgatcctgatgagtttgatcggcctgtaccttgtctggaagaaaaaaattgaaaacagcatgcgttacttgaaatggctgttcccttgcatgtttatcccgacgatcggcaactcgttcggctggattatgtctgaaatgggccggcagccatgggtggtaaacggcttgatgaaaacaagtgcgggcgtttcgccgaatgtttcggccggcgagctgctgttttcactggttgcgttctcgattgtctatacgctgcttgccgtggcaatggcttacctgtttatccgcgttattaaacagggcccgcaggcaaaaccgatggaagacattactgcatcggatcctttcaatacaaggagggttgtataatgcagttaaatgaattgtggtttttgctcgtttgtgtgttatttgtcggatttgtatttctggaaggttttgatttcggagtcgggatgagcacaaaattccttgccaaaaatgagacggaaaaacgggtgctcattaatacgatcgggccgttctgggatgccaatgaagtatggctcctgacagcgggcggcgccatgtttgctgctttcccgaactggtatgccacgctttttagcggctattaccttgcctttgtcgtcctgctgcttgcgcttattgccagaggggttgcctttgaattccgcggcaaactccaggcaagcaaatggaaaggtatttgggactgggccattttgcttggaagcctcctgccgccgtttttgcttggtgctctgttttccgggatgatcaaggggcttccgattgaccgctcgatgacgatgcatgccggatttttcgacatcgtcaacctctacacgatcgtcggcgggcttgcttttgtcgctcttgtctatctgcatggcctgatgtttatccgtttaaaaacggatggcgaaatccgtgaacgtgccggaaaagccgcgatcaaaatgtatatcgctacaggcgccgtcgttgtcctgtttaccgtattaaccgctgtttttacagacgcgtttgtgaaacggggtgccattttaattccggtctatgccgttgccatcgtgctttatctggcactgtatccgcttttgcggaataaaaaagaaggattgagttttgccgtaaccgggttgattttaattcttgtaaccgtctcgtttttcatcgcacttttcccgaacgtgctgatcagttcaatgggggcggcgaacaacttgacgctttataaagcatcgtcaagcccgtattcgttaaaaatcatgacgatcgtcgcatgcacgatggtaccggtcgtgctcgcttacacgatttggagttactacgtcttccggaaacgggttacaccgcatgaattgcattattaaaaaagttcagggggcgggggttaaagatcgccgtccactgctcacccggggagcggatttcgggcaaaccgggtgttttctttttcattcggcaccgtttggacgggtgcggagagaagcagatcaatacgggaatagggaatggatactactcctggaatggaaccttttggatgggtacggagagaagcagtccgcatattgcggattgaagcaggaacctggcacgatcttagggactccgtacaggtgaaaatatgccaatgaacgaatcaaaaaagccctgcgtatggcggaatggccccataccggagaggagctggtgcggatggataaacatctgatgcagtataaaggcagcttaaaaacttttatcattgccggatgcctgacgatgatccaatcggttgctattatcgtgcaggcagtatacctggcaaaagcgattgtccatttatacaaaggggtgccgtggcaggaagcagcggctgaatttggcatctttttcgccgcccatctcatccgccactttttgcagtgggcaaagtcgcgggttgcgttccggtttgccggccgcacgtccctccattaccaaaacttgctcgttgaaaagctgtttcgcatcggaccgcgcgccatcagcaggcatggcacgggcaatctggtgacgctttgccttgagggcattccggagttccgtacttatttagagctttttattccacggtttatcgcgtgcctgacgatcccggctgttctccttgtgtatattttttcacaggatgttgaaaccgggatcacgctgctggttgtcatgccgattttaatcgggtttttgattctgctcgggctcgccgcgcaaaagcagaaagaagcgagatgggaaacgtaccagctgctttcccgccattttgtggactcgttaagggggctcgtgacgctgaaatttttagggcggagcaaaagccataaagaagccatttgggaagtcagcaacaagtaccggattgccacaaaccgcacgctcaggattgcttttttatcgtcgttttccctagacttttttgcgactttgtccgtggcggtcgtggccgtggaactcgggctccggctgattaacgggcaaatcggatttgaaccggcccttgcgcttttaattctcgcgccggagtattttatgccggtccgcgatcttggcagcgattaccatgccacgatgaacggcaaagaagcgggcgagaagatccaccgcctgcttgccgaaaaagaagactttggaaacgggctttcttttcccgtcccggtttggaacgaacacagtacattaacagtggaagggctcgaaaaacagtcgccggaagaaaaccgggcgatcttgcaagatgtcacgtttaccgcccgcgggtttcaaaaaatcggtgtgatcggaatctccggttcgggcaaatcgacgctgattgacctgttatccgggttctccatgccggatggcggacggatcaggattgacggcctggaagttccgcatttgtcctttacagaatggcaaaagcaggtgaactacattccgcagcatccgtatatttttgcaaagaccgtacgggaaaatattgcctggtatgcgccggatgcgccgcttgaaaagattgaggaagcggcccggacagcagggctttccgacctcatcgccagctttccgaacgggcttgatgaaaaaatcggccagggcggacgggtgctaagcggcggtgaagaacagcggattgcgcttgcgcgggcattgctggatgcacgtccggttatgcttttggatgagccgactgcgcatctcgatatcgaaacggaacaggaaattaaacagctgatgctcccgctttttgaacataaacttgtcttttttgccacccaccgcctgcactgggtaaaagaaatggatttgattttggtgatggatggcggcaggcttagagaagcgggcacatacgatgagctgtaccggaaaaagggcgccttttacgaacttgtcgaggcgcagcggggaggggtagaacatggcatacttcaaccggtatattaaaccgtatatccgtcagtaccggtggctgatggtagctactgtcctgcttggcattgttgcttttcttgcttcatcgatgctcacctttacgtccgggtatttgatcacaagggcttccgaaatgccggtgacgattcttttgatttatgtcccgatcgtcggcgtgcgcgctttcgggatcgcgcggccggtcgcccgttattttgagcggcttagcgggcataatacggtgttgaagattcttgctgatatgcgcgtcaaactgtatgaaatgctcgaaccgcaggcgctgtttatccgctcgcgttttcaggcgggggatctgctcggcacgcttgccgatgacatcgagcacttgcaggacgcttatatccgcaccatttttcctgtcgtgacggcgctgtttttgtttttatattctgtttgcacgctggctgcatttgactggcagtttgcgttatggattgccttattaatggggatcgtcctgtttgtttacccgcttttatccttatatttcatgaaaaaacgacaaatcgcgctgaaagaaacacagagccggctgtaccgcaacgtcacggatactttattcggcatccgcgactggatcatcagcggaaagaaagaacggtttttcaagcagtttcatgaagacagccaggaaagccacgaaatggaaaggaagatgtccttttggaatcataaccggaactttcagctacaggtcatctcgggcatgattttaatatttaccggcatctgggcagggcatgccgcaatgcatggagacatcgccccgacctatattgcgtcttttacacttgtaacccttccgattctggaaggcatcatcccggcatccgtggcggtggaaaagattccggcatacaaggaatccctgcaacggattgacgcgatccggcagtacgtcccggataaaagcaggaatagcgcagttcctggagagaaagcggatatccgtttggaacatgtcttttactattatgaaaacgaaccggccgcagctttgaacgatgtgtcactcaccattccccatgggcaaaaaatcgcggtgcttggcaaaagcggagcgggcaaatcgacgcttctccatctgctgattggggcgctgcagcctgcttcagggaccgtttccatcggcgggcatgccccggcagcatacggcgaagggattcaccagctggtcagtgtcttgaaccagaaaccttatctgttcgcgacaacggtcgaaaataacgctgccctcggacgccccggcgccacatcagaagaaatagaggaggccatccggcaagtcaaacttgaccggtatctccactcccttccaaatgggatccatacccaaatggaggaaaccggccagcgtttttcgggaggcgagcggcaaagaatcgccctcgcacggatcctgctgcaaaatacgcctgtggtcattttggatgaaccgactgtcgggcttgatcccctgacagagaaagacctgctcgatacgatgtttgaagttttaaaggacaaaacggtgattttcattactcaccatctggccgggatggaaaaaatggatcagatcgtctttctggatgaaggaaaaatcgccatgcagggcacacacgcggcattgatggaaaacaatgcgcgttaccgcaaactttatcaaatggaccgcggggacgcttgaccagcccccgctttttccagtgccactgttgcagcatgggcgcctgcaagtgaatttgccgttttttatttctgcccgtgccgcgaaagaagcagatgggttatctatcgccggttgcaaaaaatagacacaatttttgaaagcgttaccattgctttcttctttacaaaccattacactgaagatgaaccgaatttggaaagggtggcgccagtgcaaacatttgatttcacaggaaaagttgcaatcgtaaccggcggcgggggaggaatcggccgcgaagcatgcttgaaactggctgcgggcggagcaaatgtcgtggtcgctgatttatctgatgaattgggagaagaaacggctggaaaaatccgtgaaaatggtggggaagcgatttttgtccggaccgatgtttccaaatccaaagatgtccaacattacgtccgaactgcgctagatacttatggaaaaattgatattcttttaaacaatgctggttgggaaggaaagatgaaaccgctcatagattatcccgaagaagtatttgataaactgatgggcattaatgtacgcggcgtctttcttggtatgaagtatgtgttgccgcatatgatcagccaaaaaagcggcaccattgtcaatacggcttctgttgccggcctcgtcggcacaccggaaatggtggcatacggcgccagtaagcatgcggtgatcggcatgacgaaaacggcaggaattgaggcagctccgtccggcgtccgtgtcaatgcggtatgtccaggggttgtggacacagaaatgatgagaaaaattgaaagcggttttgccggaggtgattcagcagctgctgaacaaacgaggcagcaaatggctgcatccgccccgactggccgctatacacaaccggaagaagtggcgaatgttctgctctatcttgcatcagacctgtcttcccatatcattgggcaaacggttgtcattgatggcggggcagtcctttcctaaagtccggctgtaatatctattataagaaataacaatttcgataaatggagggaagctcccgggtataccgtctgcagtataacgcctggctgtacagcgtaaacaagttgatttggcttccctccgtaaagctgaaaaaatatataaaataaataaaatctctcagctctgttgcctgctgcaaaaagtatcgtcatgcaaatcggtgcccaggcttgatgtaaaaactcaagttcattttatatagaatatgtagagatacccttctttcatcaaatcaatggtatcatcaatcgttttttcattaggaatttgcccagccattgctctgctccttttttcatgtgcccgttttccccggctgcttccggaaaaaacagggcacatcctttttttatcttcttacactttttcatcttcattcaaacattgcacgcaacataatcgaagtttacccgcaagccggcgaaattatgccatgtttcggttcacatccaaacagggtataaggaaatagaaatgcaaaaggagagggaagaaaatggcaaaggaaatcaatgtgggcatcggatttgcaacaggaagaaaaagttttaaaaacgttttaaaaacgtatatgtataacttgaaggaatccgaactgacggagagcgacaggatcaagctgcatttgtttgttgcctatgatttgcactacgaaaatgcagagcctgaagactttgtacatattgaaacggaatgcatggaagatattgaccgggcttatttcatcggggagaaggagacgcgtaaagcaaccgaagaactcgtatcccaaatgggcatgagcagaaaagaagcagtccttttgttcgacgaaggatacgcgtccaaacgcaatatcatcgtttatgaggcgttgaaaagaggcatcgattatctcatttttcttgatgatgacgagtatccggttgccgtgacaaaaagcaggcaaacggctgtctgggggggccagcaagtgctccggaagcatttggaacatatccggaatgccgatattacgaacggataccattgcggctacatttccccgattccgttcatttctttcaatgacgtcctgcaagaaaaagatttccgcacgctcattgaggccttgagcaacgatattgtcaattgggatacgatcaaaaccgtgatgaaaaacggcggggtgacatatgccgatacaggtgtgctggtaaaggatgaggcggaagaagtgccggagatcaacagggcaaaatttatttcaggatcgaatttgacactgaatttaacagatccggaccgtgtactgccgttttacaatccgccgaatgcacggggcgaggatactttcttaggcacatgcctgacagaccggaccgtgttgcgcgtgccggcctatactttccatgacggtttcggcgcttaccagcatttgctgctcggggtgctgccgaccaatttaagctatattaaagcggatacgaaacaggtcgtggaacgtttttacaaagcatgtgtcggctggatccggtacaagccgctttatgtgtatatcactgacagggaaaactatgatgaaaaaatggcggaagtgcgtgcccggctgaaagagacgcttccgaaagtttgccgctacttcggacgggatgactttatgaatgtactggaggaattcgagcagtaccaccgcaacgtcagacagcattaccgcgattttcaggatacaaaagcagcctggaggaaaataaccgcgcaattggtttcaagagaaaaaaggaaaacagccatttaagccgctttggatggagcggctttttgccggttggaaaggaaaaacctggccggatggggaaagccataggggagatccctttcgcgcatagccgcccatcccgcaacgctggtgcaaattgtccacggccgctttttgcacggccggagacccgggtgaaaataatggccccttatgcatgatattgccgctctgttgcctgctgcaaaaagtcatcctcatgcaaattggcgcctggtcctggggaggaatttaagttcatttatatagcatcatgtttaattattggtgtatggggtataagaatggtattcttttagaggcggggccatttttccctgtcctggctgcgcttcggacaggccgcaaaaaacgcgggcggccgccgcttcaacagccatccttttatcataatagatgaggtgtggagaaatgagatcgattgtaaatgaacaagaagaaattattgcataccttaaaaaaaatagaaacagcttcgaacagaagttattaaatgaagctgtaaatgttaaggataaaattgatgaaattttaagaatagggaacattgatttgttgaacaacgcttttaaaattgtgacgtatgtcgtcgagcagcaggatgaggaattggtcgcctttgcccgccaggaagggattgcctgggcaactcattctttgacgctcggactgaaactggagtgggtgcaggcgatccgccggacattatgggtattccttagaaagtacggggaagaaaaagggattgaagtagaccaggactacttttttgacatggagaaaaaaatcaatgaccgtattgaccaatttttaaatcacttttttatccggtattctacctataaagatgagctgatcgaccagcaaaaaagattggtggaaaacctctccgtcccgatcattcccattacatcgagcgtctgtattttgccgttaatcggttctattgacatgttccgcaccaatattttggaagaaaaagttttgcttgaggtggggcggctgcatatccaaacgttgatcatggatttctccggcattgcagaagtagagatggatgtagtcgaccatatttttaagatgatagacggcacttcgatgatgggatgcaaagtggtcattaccggtttgcgcccggaaattgtaaggcagatggtcacaagtggcctttcctttgaaaataaagcagagacaaaagggacattacagcaggcattgaaaaaatatattcagtatgatgatttaaacagggaaatcaagctgtattaacagtgatattgtagaaaccatcaaaaaggccccgcactttttcaggcggcggggcctttttttacggctgaaaacttaaagcgtctaggatccggttacgggctttgcgccgggcgcccgcaatttcccgtaaattccgcccgggggaaaatgcatcgcctaatggtccgttccgtgggaaaggcaagaccaggctaccccgcgaagcttttccgggctgctacaagctttgttcccttgcttggacggcacgcgtttcttttgtgcggtgttccagccggctgaataaaagcccgatggcagttccgcacagggctggcactacccattcaaggccggcggaggcaagcggcagtttttgggcgaatgccccgataaagccaagcggaacgccgaatcctttcagaccttcgattaaagcaaacacgcctgtaaacaacaatgcaaagccgtatactttctttgagccgcggaacgccgtgtggaaaaatgtcaggacaacgagcatgatcgtaaccggataagccatttccaaaaacgggacagaaaattttaaaatggtattgagcccgagattggacagcgtaaagccggtaagggtaacggcaatgacaacaccatggtagctgaacttcggcaccagattggaaaaatattgtccgcacgctgtcgttaagccgacgacggttgtaaaacaggccagcataaagataaaaccaagcagtatttttccagcctgcccgaatagcagggaagacactgccgtcaggacatcggtgccattttggaacgtgccgcttgaagccatttttgcgccgatcaatccgagtgcgacatagacgagtgccaaaatcgcgccggcaatcaacccggcttttaatgtataggccgtcatttgtttccggttagcgatgccgcgatgtttgaccgctgttaaaatgacgatgccaaacgccagggaggcgagcgcatccatcgtggagtatccgtcaataaaacctttatagaaagaaccggtctggtatccggctagcggcgccgtaaacgggcggccagagagtttgaagaaaccggctgcgcaaaggacggccattgccagcaataataccggtgtaatccagcgcccgagcgtatttgacattttatcaggatttagactggtcaaatagacgagcaggaaaaagacgatgctgaacaacaataaagagaccggcgaactgtgggcggacccggaaagaaacggtttaacccccatttcataagcaacgtttgcatttctcgggatcgccaaaaacggcccgatacataaatagacaatcacggtaaataccgtactgaagaccggatggacacggttcccgatcgcctggatgccgccgtctacaaacgaaactgcggcgataacgagcaccggcagcccgactcccgttacgataaaccctgccattgctggccagtaagacgatcctgactgaatgccgagaaaaggagggaaaattaaattcccggctccgaaaaacatggaaaacaacataaagccgataaacaatacttcgtttcttttcatcctatgtccgcttcctttcgatgcaataatgtagagaaaaacaaaaaacccgcccctgaaacagggacgagtttgctcgcgttaccacccttattccgcacaaaaacgtgcggcacctcattcaacgtaccaacatacgtgttcctttcttaacgggggaatcaccgtcaaagcctactaaaaacttcagctttgcatctcggggatgatcttcggaatggccttgaacattggctttcagcaatatgccaactctctggggaacaagatccaaacttactcttcccgtcctcgacttttgtttttcatattatttgaaaataagattatcactgaacatttcatctgtcaacatctctttcggaaaattttcaaccccgtgcccgcgatcaaaatggacagaagccgcaaaatgatgccgtttttggataagtcaaaacccggccaatacaagcgtgatctaaaaataagaacggccgagcagcaagtacaaccagcaaaaaaaaggagtccatcctgagcaactcaaaaaatgaaaaaaagaaaagtcaataaaatcaataatgaaagcgtttccaaatagattttcaaatcaaaattgtcaaaaaagttgacagaaaagggttgacctcggcaatcaaaagtcgtatgattgacaacaattaaagaatataaaaaattttttcgggcggatatttaaagaaccggattttcaccgggcataagaaataccccgcaggcaatagaatgggagtgatggaatgcgaagtgacatgatcaaaaaagggatcgaccgtgccccgcaccgaagccttttatatgcagcagggctgaaaacggaagacttcgacaagcctttcatcggggtgtgcaattcctatattgatattatcccggggcacagacacctcaataagtttgcggaagtagtaaaagaggcgatcagggaagcgggcggtgtcccgtttgaatttaatacgatcggggtggatgacggcattgcgatggggcatatcggcatgcggtattcgcttccgagccgcgaattgattgccgacagtgccgaaacggtcatcaacgcccactggtttgacggggtcttttacattccaaactgtgacaagatcacccctggcatgctgatggcagccgtgaggacaaatgtgccggcagtctttgtttccgggggaccgatggaagccggtatggcgccggatggaaaacaattgtcccttacatcggtatttgaaggcgttggcgcccataaatccggaaaaatcagttatgaagagctgaaaatgctggaaacgagcgcctgcccgacatgcggatcgtgttcaggcatgtttacggcaaactcgatgaattcattaatggaaatgcttggcctgacgccgcccggcaacgccaccatcgttgccacgtcggaggaacggcaccgcattatccgggaagccgtcgggcacttaatgaactgtatcaaaaacgatatccggccgcgcgatattgtcacagaagaagcgattgatgatgctttcgcacttgatatggcaatgggcggttcaaccaataccgtgctacatacgctggccattgcccgggaagcaggaattgactacgatttggaacggattaacaaggtggcagaaagagtcccgtatctggcgaaaattatgccggcgtcggattactcgatgcacgacgtccatcttgcaggcggaatcagcgccattgtccatgaactttgcaagattgaaggggcgattcaccccggccggctgacgatcaccggcaaaagcatctatgaaaatgtgaaagatgcggaaatccgtaatcctgaagtgatcaggccgaaagaaaatccttacagcccggtcggcggtttgtccatcctgtatggtaacattgccccggacggcgctgttatcaaagtgggagcggtcgatccggatattcacacctttactggggaagcgatagtattcgaatcccaggaagaggctcaaaaagggattgacagtggtcttgtccatgaagggcatgtcgttgtgatccgttatgaagggccaaagggcggaccgggcatgccggaaatgctcgcgccaacatcctccattatgggccgggggcttggcaaaaccgttgccttgattacggacggcagattttccggcgcaacccgtggtatctgcgtcggccatatttcaccggaagcggcggaaggcgggccgatcgcacttgtcgaaaacggcgaccgcattacgattgatttaatcaacagaaggattgagctccatgttccggatgaggaattgcaaagaagaaaacaaaattgggtgcagccggagccgaaaatcacgagcggctacctggcaagatattccgcactcgtgacttccgcgaatacaggcggggttttaaaaatcggattaccgcaaaaaacgttgacggggacaaagtgatcggattaggtatttttcagagagccggggatgctgggagcccggtaaataccccggtcacgacatcgcctctgagtgcaagtctgaacggttctgcctactaggacttgccgggtcggccgcatgaagcggaggacccgttacaaaaagcagcattttttaaacaatgctgcatgaggcggcgtttgtgagaacgccgtgaagttgggtggtaccatgaaaagatgccttttcatccctgcaaaaccggcaaaaacgattgttccttttgccgttttcaaggagaaaaaggcattttttattgggataaatcaagaagcctgcgcaaatcagaataggaggttaaatcgtgtgtgcgaaagcaagaatggatggcaatgtgaaaacagcagaatgtacgggtgctgaggtgcttgtccagttattggtgcgggaaggggtcgacgtcatgttcggctatccagggggtgcggttttaccgatttacgatgccctttacaaccagccgataaggcatatactggcccgtcatgagcagggggccattcacgcggcagaaggttatgcgcgcgttagcggaaaaccgggtgtcgttattgcaacttcgggccccggggcaaccaacctgatcaccgggattgccgatgcgatgatggattcgcttccgctcgtcgtctttaccggccaggtcggcacttccgtcatcggctcggacgcgttccaggaagccgatgtcatcggcatgacggctccgattaccaagcacaattaccaggtaagggatttgcgggatttgccgcgggtcgtcaaagaagcttttcatattgcaaaatccggccggcccggaccggtggtggtcgatatcccgaaagatatccagcagggaacggtggaaatgggagaaagccgggaagtatatctgcccggttaccagccgaatacaagcccgaatccgctccagattaaaaagcttgtggaagctgtctcttattccgaaaaaccggtcatattggcaggcgccggaatcctccatgcaaaggcgtctgatcttttactcaagtttgcggaaaagtgccagatcccggtcgtaaacacgctgctcggccttggcagttttccgttccgtcacccgctttttctcggcatgggcggcatgcatggaacgtatgcggcaaatatggccatttgcgaatgcgatctgctcattaatatcggggcccggtttgatgatcgtctgacaggcaacttagcccactttgccccgaatgcaatggttgtccatattgatatcgacccggctgaaatcggaaaaaatgtcaaaaccgatatcccgatcgtggcagatgcaaaggaagccttgcagaagatttgttcggaagatttgcaaaatgccggcacggatgaatgggtccgccatttaaaaaaatacgccgaaaatttcccgctttggtacgaagatgatggtgagcaattgtccccgcagcatgtcattcaaagaatccatcattacacaaacggggatgcgatcatttcgacggatgtcggccagcaccagatgtgggcggcacagtattacgggtttgaaaagccgcacaagtggattacatccggcgggctcggcacgatgggattcgggtttccggcggcgatcggcgcgcaaatcgcatatccggaccaactggtggtttcgatcagcggcgacggcggcttccagatgacattacaggaacttgccgttgtaaaagagttaaatctgccgctcaaaatatttattgtgaataaccagtatctcggtatggtacggcagtggcaggaatctttctacgaagaacgctattcctattcgacgatcccggtgcagcccgactttgtcaaacttgcagaaagctacggcatcagaggctgccgcgcaacgaacaatgaagaactcgacaaggtgctgaaaactgttttcgaggatgacgggcctgtcgttgtcgactgccgcgtgaaaaggcttgaagctgtgttcccgatggtcgcgccgggcaaggggctgcatgaaatgatgggggtgaagccatgaagcggattgttgtagccactgttttaaaccagagcggggtgctgaataaaattaccggcgtcctcgcaaagcggcagtttaatattgacagcattacggtcggacgcactgaaacggaaggcatctcgcgcatgaccattgtcgtcaatgttgaagacgacaggcaggcagagcagctgacaaaacagctgaacaagctgatcgatgtgatcaaagtccaggacatcacaggccaggcgatcgtctcacgggaacttgccttgattaaagtattgagcacaccgcagacgagaagcgaaattggcgggcttgtcgaaccgttccgtgcctccatcatagatgtcagcagggaatctgtcaccatccaggtaaccggtgacagcgacaaggtggaggcgctcgttgacctgcttaaaccgtacggcattaaagaaatggtccgtaccgggatgaccgcatttctgcgcggctcgcaaaaacaagtaaccgatttaagctcttattctctattaaaataaaaatcttaaacttaaaaggagagaatgaaaaatggcaaaagtttatcttgacaaagacatcaaagaagaagcattgagaggaaaaaaaatcgccgttgttggctacggctcccagggccatgcccatgcccaaaacctccgtgataacggttttgacgtagttgtcggcgtcaggccgggccggtcgtttaaccgcgcggaacaggatggattttccgttaagcctgtgaaggaagccgcaaaagaagccgatgttatcatgatgcttctgccggatgagcagcaaacaaaagtatacaaagaagaagtggaagcagggctcgaacctggcaatgccatcgcatttgcccacggattcaacatccattttacccagattgtcccaccggaaaatgtcgatgtctttatggtagcgccaaaaggcccgggacatctcgtcagaaggacatttgaagaaggagccggggtgcctgcgctgattgccgttcaccaggatgtgacgggggaagcaaaagacctggcgtttgcttatgcaaaaggaatcggggctgcccgggccggcgttttggaaacaactttccaggaagaaaccgaaacggatttgttcggtgagcaggctgtcctgtgcggcggtttgacctctttaatcaaagccggttttgaaacgttaacggaagcagggtaccagccggaactcgcttattttgaagtgtgtcatgagatgaagttgatcgtcgatttgatctatgaaggaggtctgaaaaatatgcgctattccatctccgatacggcgcaatggggcgatttcgtctccggcccgcgcgttgtgaacgaagatacgaaaaagcgcatgaaagaggttttaaaagatatccaaaacggcacatttgccaaaggatggctgcttgaaaaccagacaaaccgcccaatgttcaatgccatcaatacacgcgagcaaaatcatccgctcgaaaaagtcggagaagaactgcgtgatttaatgccttttgtcaaaaatccgattaaacaaaaggaagtggctgtgaatgcaaaaggttaatgtttttgacacgacattaagggacggggaacaatcggcaggcgtcaatctcaacaccgtggaaaaagtcgaaattgccaaacagctggaaaagcttggcgtggatattatggaggcggggtttcctgcatcttcaaaaggggattttgaagcggttgagaaaatcgcaaaaacggtccgaaacagttccgttaccggtctggcgagggcatacaaacaggacattgatgcagcctgggatgcactgaaacattccgccgagccaaggatccatatttttctggccacatcgccgattcatatgcaatacaaattgcgaaaaacgccggatgaagtggcagccatcgctgttgaagccgtgaaatatgcgaagcaaaaattcccgctggtgcaatggtcggcagaagatgcgacgaggtcggataaagactttctcgtccggatcattacagaagtgatccatgccggcgcaaatgtcatcaacctgccggacactgtcggctatacgacgccgaaagaatacggtgcactgtatgactatattcaggaacacgtcccgaatattgataaagtcattttatccgcccattgccatgatgatctcgggatggcgacggccaatacgctttcagccattgaacatggagtccagcaagtggaagggacgatcaacggcatcggcgaacgggcaggcaatgttgccctcgaagaagtggcggtcgcccttcacatcaggcaggattattacaagaagaaaacccgcttgaaattggatgaaatcaaacgcacaagccaattggtcagcaaactgaccgggatggttgtaccaggcaataaagcggttgtcggcgccaatgcttttgcccatgaagccggcattcatcaggacggcgtgttaaaagaggcttcgacatatgaaatcattacgccggaactggttggattctcaagcaaccggcttgtgctcggaaaacattccggccgccacgcttttaaagaaagagcagcagcgctcggctttgatcttgggcaggaaaaactgaacgaagcgtttaaagctttcaaagcattgacggataagaaaaaagaagtgaccgatgacgatttgttcgccattttagccgaaaagcaaaccgatgcggcagatgctgcccattatgaactggaaagtgtgcaggtgcagtacggcacattgaatattccgaccgccacagtaagaatcaaaacaccggaaggaacgcttgttgaagaagccagcaccggatcggggagcgttgaggcgatttaccatacgatcagcaagctgtttgacggcccgattgagctgaaagactataaactgcagtcagtcggttccggccaggatgcgcttgcggatgcatatgtcaaagtgaaattcggggagtttgaatgtggcgggcgcggttctgcccaagacgtactggaagcttccgcaaaatcatttttaaatgcaatcaacagggcgcacgcaatggaacagcaatcgagaaaacaagtacaggtgtgattttcggggaggaacgacaatgaaaatgaaactggccgtactgcccggtgatgggatcgggccggaagtgatggatgcagcgatccgcgttttaaaaaccgtattggacaattacgggcatgaagccgtttttgaaaatgcgctgatcgggggcgccgctattgatgaagcggggacgcccctcccggaagaaacgcttgacatttgccgcaggagcgatgccattttgcttggcgcagtaggggggccgaaatgggatcataacccggcttccctccgcccggaaaaaggcctgcttggaatccggaaagaaatggggctgtttgcgaacctgcgcccggttaaagcatatgccccgcttttaaatgcatcgcctttaaaacgggaacgggtggaaaacgtcgatcttgttatcgtccgcgaactgacgggtggcctctattttgggcgcccgagtgaaaggcgcgggccggacgggaatgaagtgatagacacgcttgcttatacaagggaagagattgagagaattattgaaaaagcattccagcttgcgcaaatcagaagaaaaaaactggcgtccgtcgataaggcgaatgtactggaatcaagcagaatgtggcgcgaaattgcggaggaaaccgcgaaaaagtatccggatgtggaagtaagccatatgcttgtcgactccacctcgatgcagctgattgcaaatccgggccaatttgatgtcattgtaactgagaatatgttcggtgatattttaagcgatgaagcgtctgtgattaccggcagtctcggcatgcttccatccgcaagcctccgttccgaccggttcggcatgtatgaaccggtccacggctcagcgccggatatcgccgggcagggaaaagccaatccgctcgggatggtgctgtcggcggctttgatgctccgttattcgttcggacttgagaaagaagcggcggcgattgaaaaagcggtggatgatgtgctgcaagacggttattgtacaggtgatttgcaggtgaaaaacggaaaagtggtcagcacccatgagctcacagacaaactgattgaaaaattaaataacagtgaagcccgtccccgcattttgcaatgagcgtatttttcaacagaaaataagtagctgtttacggcggtccacacgttttccgggatggaaaaacagtgcagtttttaatcacaggaagaggcgaaacggagattgatctaaaaaaacgaaaagcggcagatgggagtgatacgatggcaccgaaaacgattatcgataaaatatgggaaaaccatttggtccactgcgaagaagggaaaccgaacctgctctatattgacctgcaccttgtccatgaggttacgtccccgcaggcgtttgaggggttacggatgaatggccgcaaagtgcggaggccggatttaacattcgccaccgttgaccataatgttgcgacaacaaagggcagggtttcaaaagacccggtctcgaaaaaacaaatgtccactttggagaaaaattgccaggaattcggcatcccgcttgccggcatcaaccatccagaccaggggattgttcatgtgatcgggccggaactgggactcacccagcccgggaaaacgatcgtatgcggcgacagccacacgtccacgcacggtgcattcggcgccattgctttcggaatcggcacgagtgaagtagaacacgtgctggcaacccaaacattatggcaaaagcgcccgaaaacgatgcaaatcaaaatcaacggaaaactggggccaggcgtgacggctaaagatttaatccttgccatcattgcaaaattcgggattggcgtcggcaccggccatattgtcgaatacacaggtgaagcgatccgcaatttatccatggaagagcggatgaccgtctgcaatatgtcgattgaagcaggggccagggcggggttgatcagcccggatgaaacgaccatttcctttttgcgcggaaggaaatatgcgccgaaggaaaattttgaagaaaaagcggcatactggctctcgctggcatcagacgaaggcgccgtctatgacaaaacgcttgaaatggacgcagcagaaattgagccgcaggttacatggggtacaaatccatccatgtgcctccctatcagtgaaacattgccggatccggctgaaatcaacgatccaggcgaacggcaggcggttgaaaaagcgttgcaatacatgggccttgaaccggggatgaaaatcacagacatccctgtccagcacgtgtttatcggctcgtgcacgaactcgcggattgccgatttgcgggctgcagctgaagttgtaaagggccggcatgtaagagaaggggtccgggccctcattgtgccggggtcgcaaagtgtaaaagcacaggcggaagaagaagggctggacaaaatatttacacaagccgggtttgaatggcgcgagtcgggctgcagcatgtgccttgccatgaatgatgatattgtcccggccggagaacgatgcgcctccacatcgaaccgcaacttcgaaggccggcaaggaacaggcgccagaacgcatcttgtcagcccggcaatggcagccgccgccgccatttatggcaaatttgtcgatgtccggaagctcggccagcctgagccggtccgctaaatggcggcatgccgtgctgcttcttttgcagcaggcagcagaagaaaattcattcatctatacgaagagagggggcaaaagcaaatggagccatttcaaactttttcagggctcgtattcccattggacaggaaaaatgtcgataccgaccagatcattccgaaacagtttttgaaaaggattgagcgccaagggttcggagaatgcttgttttacaactggcgcttcgatgaaaacggaaataaaagggaagattttcctttaaatgacccgaaatacgagggtgcgcagattttagtggcaggcgacaacttcggatgcggctcttcacgggagcacgcgccttgggcattacaggattacggctttaaagtggttatcgcaccaagttttgccgatattttccataataactgtctgaaaaacggaattttaaccgtagagctgccggaagaagaagtgcacgatttgattgacaaggcacagagagaacggctctttttaacggttgatcttgaaaaacaagtggtattaacgggagaaaaggccatccactttgacattgatccgtatccgaagaatatgctgttaaagggactggatgaaatcgggctgacattattgcttgaagatgaaatttcaaaatttgaagcgtctgaaaacgcaggagtgtgacgagaacaatggggatttcttacaaacgaaagacattgtagcagcatttgaaaatttattgccggtcgtgcaccggacgccgttgaacgaatcggcgacatttaatgaaatggcagggacaaggctttactttaaaatggaaaacctgcagcgcacagggtcttttaaaatcaggggtgcactgaataagattacgaacttaacaggggatgcgagaaaaaacggcgtgattgcggcatctgcgggcaatcatgcgcaaggtgttgcgttttcagcaacgaaacaggggttgaaggcaaaaatatatatgccggaaaaaacgccgcttgccaaagtgttggcaacaaaggcgtatggtgcggaagtcgtgctgaccggcgaatcttttcaggaagcgtatgaagcggctgtgttggaccagcaaatcacaggggcaacgtttattcacccgtttgacgattatgaagtgatggccggccagggaacgatcgctctcgaaatgatccagcaatgcgcggatcttgatacggttgtgattccggtcgggggcggcggcttaattgccggcatggcctgtctcctgaaaaattatgatccgaaaatccgcgtcatcggcgtgcagtccgagggggcgcctgccgcctataatcgctttaaagggatgggcaacagccggctcgaacatgtttcgggcatcgcggacggtattcttgtaaaagagaccggccagctgacttttccgttaatcagcaagtatgtggatgatgtcgtgacggtgagcgatgaagacattgccactgccatcatttatatgctcgaacgcgaaaaaatgtttgtcgaaggggctggagcggcggcattcgcggctgcattaagcggcaaagctggcgtttcaggcaagcacgtcggcattgttgtaagcggcggaaatgctgatctggataaaatttcccacttcaaacggctggctgtggccggcaaaaaaaaacatagggttgtgtcgctttagaattgggcaccagaccggggcatgccgggcgttttcactaggctgtgccccggggcgccttttctttgtgcaggccgaaaagggagaaaacgatacaaaaaaacagcatcctttgttacactgaagtaggaaagaggtgaagagatgattcaaacggtattatttgatgtggacggcgtattgctgagcgaggaacgttattttgacgcatccggcttaaccgtctgggaattgatacatagcggccattatttagggctcgcaccggaacaatttaaaacagccttaacagatgaggaaatcaggcgcatccgggctgatgtttttcagcatgatgaagtgctgcggtttttaaaatcgcgcggtatgaacgcgaactgggatatgatttatttaacgttcacctcccagcttttacacttgttttcacaaataaaggaaaaggaagcgggccggatccgcggctggctgtcacgtgaaatcgatgatgaaacgcttcatgaaatccgcggggtgcttgcacactatccggttgaaaccgactatggcatctttttaaactggtttgcaaagaggcctgaaacgaaacaggatttattgaaagtgctggatcagcttgcttatgaaatcttcgggcttacagatacacagcttggcaaaaaaggcgcgctctggtcggtgtgcgagcatgcttcccaggaatggtatgtgggcgaccaaaatattgtggcatctaccgggaagccgagcgtgcaaacgggaaaaaaagggtttctcgatgaggagattccgcttgccgaaccggaaaaaatcggtgccttgttttcctttttggcagagaaagggctgaaacttggtgtcggcacgggaaggccgcagcttgaaacgtacgggccgttccggtcgcttggctggctgccgctgtttcatgaggagcatatcgtaacggcggacgacgttttaaaggcggaagaggagcttggagaccatacgccgcttgcaaagccgaacccgttcacctacctgcttgctttaaaagggaaaaacacgcccgcccgcgactgtacggaatgcagcctcccgcttgaaaacgggcaggaaatcctgattgtcggggattcgcttgcagacctgcttgctgcgcaaaaaataggcgcccaatttgccggcattttaaccggcttgtccggaaaagaagcaaaagccgaatttgaagagcacggggcagattatatttttgaaaatgtggcagacctcaaaaacatatttttgtagagctggggcatgcgaaggcatgcctctttttcgcaggacattccgctacgtgaaaaatggcattttttgaaaagaaaatttttgtagggaaatctaacatgatcattttattaatatagtgtaattttgccagttcctctataaaaatgaagataaaagtttgaaaaaaatatttttaaataaaattaaatgttgactttattttgaaactaacgtaatattttaacatcataaaaaaaaggagcggaaatctagatggacaagccggcatttggcggaaatcattgaagacggaaaataaaacagaaacggggatcgtaatggcttttaaattcggaatatttcaaggagtggaaaagatgaagcaagcaactaaagattatgtcattgacagggcgtataaagcatctgccggggtagcaaacgctgtgctcgtgactttgggtctgggacttttgtttgaaacgtttgggaaattcctcggctgggacggctttttggccatcggggcagcaacgaaatcgctgttggcaccggccatcggcgcaggcgttgcataccagctcggcggcaatacattggtcattttcagttcgatggcttgtgcggcagtcggcggaaacgcgatcggcacaacccaggacggcttgattacgattgttaccggacaacctgtaagtgctgtgctggctgcagttgtcgcaacgtgggtcggaaaacgcgtgactggcaaaacaaagctcgatatgatggcaattccgtttgccgcgattcttgttggcggtgttgccggcgttggccttgctgctgtcaccacgccgtttttgcaatggctgagcggtgaaattacggcgtctgtacaaggttcgccgcttttcggttcaatggttgtatcgctcgtctggagcatcctcctcatgtcacctgcttcttcggccgcgcttgccattgcgctgcagcttgatccggtatccagcgcagctgcactgatcggctgtacggtccagtttgtcggttttacggcaatgtcgctgaaacaaaatgactggggcggcaatattgcacagtcattgattacaccaaaagtccagttcccgaatttggtgaaaaatccgcgccttgtcattccaccgtttgtttcgtcgctcatttgtgcgccagttgcaacgatgatgttccatttgaaggtgccgtatgaactcggcgggcttggcctgaattctttaattgcaccgcttaatattctcgcaaatcagggaatgcgcgtgctgcttgcttatgttgcggcaggtgtgattttacccatttttacgacgctcggcatctatcatttccttaaattgttcggctgggcaaaaactggcgaccttaggatggaggtccaataaaaaccgggtcgtacaagcctcattttgacttgtattcgaaaaaagcattcacagcgttttgccgtgaatgctttttatttatacttctacaaaaggttcttcctgaaaggtatagccggttgcgagttccaaagtctgaacggctttaatgccgattacctcttttaattggtccagcacttgccggcttgcggttttatcgagcgtgagcaccatgatcgcttccccgccgatttctttccggcccacctgcatcgtgccgatattggtatcattgctgccgagaatcgatccgacctgaccgatcatgcccgggatgtccagatgccggatataaagaaggtgctgttccgggcggagatcgacacggtaatcgttcagcttcacgatgcggccaccgaacccgttaatgatcgaagcgccgatattcacttgtttgccttttttatacagtgccaattccaaataattggaaaagcccttaaacgacgcattgcgctgcagattgtatgtcaacccctgttcctttaagagatggagggcattgacaagattaacggtgctgccgagatgacgcgccagaatccctttgataatcgttctcgtcagcagttttgtatcttcatccaaaagctcgccggcgtacgtaatttcaattttttccggcgcttcatccaaaagctggatgccgagctgtgccacctgttcgccaagaaggaggaacggttccatccgttcgcggttttccccggaagtttgcggcatattgatggcattgcggatctcctcagattcaaaaatatggatgatttcgtcgctgacatccgccgccacccggacctgtgcttcgcgggtcgaagcgccgagatgcggggttacaataacattcggtagttccaaaagccccggcgtgatttccggctcgttttcaaaaacgtccagagcagcccctgcaacgcggccttccttgagcgcctgaaggagtgccagttcgtcaacgagcccaccgcgtgcgcaattgatgatgcggacacctttttttgtttttgccaaaaatgcttcattgatcaaatgcctcgtttctttcatcagcggcgtatggagcgtgatgaaatcggcttgggcggcaatttcgtcaagcgttgcttttttgatgccgagcttggccgcacgttcttcggttaaatacgggtcatacccgagcacggccattccgaatgcttttgcccgtttcgccacttctgtcccgattttgcccgtcccgatgacgccgagcgttttcttgaaaagctcgacgcctttgaacttttcgcgctcccattttcccgcggatgcggacttgtgtgcctgcgggatattgcgggaaagggaaagcatcatggcgagtgtatgctccgttgcggaaatcgtatttcctcccggcgaattgacgacaataatcccttttctcgtcgcagcatcgacatcaatattgtcaacgccgaccccggcccttgcaatgacgcgcaaattgccggatgcctcaatgatgtcttttgtcacttttgtttggttccgcacaatcagcccgtcatactggccaattttggcttttaaatcttccggcgcaatgcccggctggtgttcaactaaaaaatctttgtgcgcatacagttttttcaagccttcttcgcttactttatccgttactaaaattttaaacatgcgctttccatgcctcctccgcttttttcactgcaatgccgaatgtatcctttccgttcagttcgtgtaccgccatttccagcgcggttaaaacgttgatcacgtcaaaaggggtgctgtaacccatatggccaatccggaaaatttttcccttcagctgtttttgcccgcttgcgacgaccattgaaaaatgatcctgcaaatattttttgattgccccggcctgttcgccatccggtttcaccgctgtgacggtcggcgaagcatccgcgtcgttttcgacaaggagcggaaggcccaaagctttcacgccggcgcgggtcatatcgcgcaaaatttcatggcgcttgatgacattgccccagccttcttcctcaatcatccggcacacttcttccgcgccaaacacgagggaaacgggcggggtgaacggtgttgtcacggcttcatcatatgaatcgatataccggttcaagtcgagataaaaccgtttttccggtccgttcttgattgcctctttggcccgtttattgacggcgacaaaggcaaggcccggcggcagcatgagcgctttttgcgaaccggaaacaaggatatcaatctggtaatcttccatatccgcgggcacgccgccaatgcagctgacgccgtcaacgatatacaaggcatcggtcaaccgttttacaacggcgccaaggtctttcaccgggttcaacaccgatgtggatgtttcgcaataggtggcaaaaaccgctttgaccggatcttttagccccttaaggaacgtttccagctgttccgggcggcaggcggttccccattctatattgaggcggtggacatgggcgccgtatgattcgcaaatggaagcaaaacgctccccgaacacgccggtgacaacgacaacgacatggtcgccttcatggacaacgttgcagacggcgctttccagtgcggatgtcccgctgccggcaatgacaaccaccggttcttttgtgccaaagaccggcatcagttttgtcgccacttgcttcaggctatttgaaaagacttcactgcggtgggcgaccataggctggttcatggcctgttttacacggtccggtacgggtgttgggcctggtgtgaatagcgattccttacaaaaaagcatgagtacgtcaatcctccaatataaaattaaaataaaacgtccctccgccacaaagaaatccttgtggaggagggacgtcatgtaccgtggtgccaccctcatttgctgcgtacggcagcctctgggaaaataacggcatatgccgggtgcggcctacatcactttcggccggccagttcagaagcgctgggcattgtatcagcaaaagcatcggttcgcagcaaccaccgactctctgcagctttttgcaaatacgccttcttcatcattacttttcgaatatcattttgctctttgctaaatattctaacagctgattttagttctgtaaagggaaaaatgaaataatttaaaaatcatcgtattttttgattcgcgcaaaaaggttaataaccttttttgtagtcgacaagatgaatgtccggcttgccgccagcgaggtaccgttttaaattcgggatgaagatatcccggacaacccgttcgtcgtaatgttcggttgagccggcggtgtgcggggtgatgatcacatttttcagctcccaaagcgggctgtcttcagggagcggttccttttcaaacacatccagcccggcgccggcaatttcgccggaggcaagggcatcggccagttctttttcatttgcgatttcccctctgccgatattgataaaaaatgcagacggcttcatccgggcaaatgcttctttcccgaataaatggtacgtttctttcgtaagcggcaggcagacggcgacataatcacaaagcggaagcatatcatggagctgcccgttggtatacatttcgtctacaaacccggcaggcgcaccggaacgccgcacgcccagcactttcatcccgaaggctttggcaatttttgccgtttcaagcccgatttccccgacaccgataatgccgatcaccttttcgtgcatttccagttttaacccggcatggtcccatttctttttcgtttgatatctgacatatgtatggattttccttgtcaatgccagcatcattgcaaaaatggtttcagaaatcggataggcgtggatgccgcttgcggaagtcagaaagagcccctttttctcaaattgttcgagcgggaaactgttcacccccgcactccagctttgaacccagcggagagcggaatcttccgataatgcatctttttccattttttttcgaaagctcgcaatcacttcagctttcttcacttcactctgccaatgcgccggatcttttccggccagtatgcgccattccggaaccaatttcctgatttcatcaagcaggccgggggcaagattttctgcaataatcatggttctttccgccatcaaactccctcctttattccattaaatcatatattcgatataccgtaaaaatttcctgctttttctggtaattcctgccataaacttttcacatttgcaaaaaccgccatcccttcagcctgtaagccttatcaattatttgcacgcatgtttccgggtataaagccctatgaaaaagtgactaaaaggtacgataaaagaattagtgatatccgctatgaaaatgattaaaggagttgccctgttatgcgaaagatggtagaaaaacatgtacgatggaatatgaaagcgaaattgattgtttctatcctcgcgatcctgctcgttccatctgtactgatcggatatttttcaataaaatcagcaggaagtgaagtccaatcgcaaatgctgaatgccgctacggaaaatgtcaatctgttgcagaatatcatccatgatgcgatccagccgcgcatggacgatgtggattatttttctcaaaaaatttcggcccaaacggaaaaaaaaccgtccgaaatcaagtcgatgttcagccagtacgcaaacctgcataacaatgtcctgaatgtttacgttgggacagcatccgggaaaatgatgatcgaaccgaatggcaacttgcctgcaggctatgatccaaggcaaaggccgtggtataaggaagcgatggaacagcccggaaaagcggttgtgacagccccgtaccaggacgcgaccacgggggaaacgattgtcaccattgccaaaacggcgcaagacaactccggggttgtcgcagttgacctgaaaatgagcgcggtccaaaaaatggcgaaagaaatcaaaatcgggaaaaacgggtatgcggtgcttgtagacccggcgcgccgcatcgtcgtgatgccgggaagaaaaccgggggcgtatgcaaaagaaaaagtgtatgataccgtatttaaccatgtttccggacacacttcctatacgtatcaggggaaggaaaaagtgatggtttatacaaccgacagcctgacgggttggaaaattgcagggacaatgtatgccgatgaggtcggcaaagctgtacagccgatcattgaccggatgattcttgtcatcgtcatttttctcgttctcggtacggtattagcctattttgtcatccggtctgtgacacggccgattaaccgcctgaaagaagcagcattaaaaatttcctcaggggacttaacagaggaaattgatatccggaaaaaagatgaagtcggtgaactggctgtaagttttaaaaaaatgcaggacagcctgcgcgaccttctcgaccaggtcgataaaagcgcggagatggtcgtttcctcttccgaagagctgaaggcaaatgcggaaaatacaacgcaggcaagccatgaaatcaactccgctgctgcccagattgcaagcggtgcggaaacacagacgaacggcacggaaaacagcgcccaggcgatgagcgaaatcgcaaaagcaatggaaaaagtaaccgacagcacgatggcgatttccagcctgtccaatgccacgcttgaacatgcgaaacaaggcggcgaggctgtccgtgagacggttgcacaaatgaagtccattgccggttctgtcgcgcaatctaacgcaaaaatccaggcactctttgaaaattcgaagcaaatcagccaaattacagaagtgataaaaggaattgcggcccagacgaatttgcttgctttaaatgcagcgattgaagcggcaagggcgggcgagcacggaaaagggtttgcggtcgtggcagacgaaatccggaaattggccgaccagtcgcaaaactcgaccaaagaaattgaaaagctgattacgcaaatccagcatgatacggaagattccgtccgcgaaatggaacaagtgtccaaagatgtggaagccggcgtgtcacgttccaaagattcgatcggaaaatttgacacgatcatgaacgggatgaaagaaatcacaccgcaagtagaagaaatggcggcgatctcggaagaaatttccgcctccgtccaggaagtgacttcgactgcgaacgaacttgcccaaattgctgaagaaaatgcggcggcaaccgaagaaatggccgcttccattgaaagccacctgaaatcgatggatgacatcagcgattcggccagagcgttgtcctatctggcggagtacttgcaggaaatggtgaagaaatacaagttttaaagaagaagcgcccaaagcaggaatctaggctttgggcgctttttttggcgcatggattcaactgaaaacgggttccgcccgggcaaagcaaaaggcaatgcaagtgcgggaattttgggggatgaattttgcccgccgcacaacggccgtggcagttgccacgcgagaaaacgatggagcagcggtcactttgcaaaagggctttaggacgccggcaaaaagttttcggtgacaatggctccggcgtccattaaaataaaactaggaagatgatgaacaaattttttgaaaaaggaaattcccttatggaggagagaaaagcatgcatacatatgtcaattggcctgatgtggtatttcagttgagctggctcatttttctctgtgccgccggatttgcgatttataaaatcttgaaaatcaggaaaatgaagaatcagcatttgaaaaaatagtgcaggaacggctctgggcctctccggagaaagggctgcaggacgggcaaaaacgggaggaaatgggatggaactcacaaaggaacaatttaaggccgatttcgaaaggatgctgtcggactgcttcacaatggatgtggaaaaatctgatttgacagaacagtatgttacactcggaaaattgatcggttcatatgcagcgaaagaatggcggaacacgaatcagcgttacttggaaaaaggggagaaacaagtttactatttttcaatggaatttttgcttggcaggatgttgaaaagcaatttgttcaaccttggcattctcgatacagtccgggcggggcttcaagaaatggggatggaactcgaggcattggaacaggtggaactggatgccgggctgggaaacggcggccttggccggctggcagcttgtttcatcgactcaatggcgacacatgcgatccccgggcacggaaacggtatccgttttaagtacgggcttttcaggcagaagtttgtcaacggctaccaggtcgaactgcctgaaaattggctgcggaatggcaatgtgtgggagacccgccggctgaacaaggcggtaaatgtgcggttttacggcaacgtccggcttgagaaagacgcatcggggcattttgtcccccattatgaaaatgaagaaacggtgcttgccgtgccgtatgataccccggtaatcggttacggggacaacacggtcaacactttaagattgtggtcggcagaaatgccgctgcaggatgcgaacacggagtaccatgcttttattcagcagcagagccggatcgaaagcatttccgaagtgctgtatccggacgattccaattatgaagggcgcctgttgcgtttgaagcaagaatattttttcgtctcggccggcattcaaagcattatccgcacctataaaaaactcggcctgccgattgcgcatctggccgaaaaagtcgccatccacatcaatgatacacacccggcattgtgtgtccccgaactgatgcgcattttactggatgaggaagggatgggctgggaaccggcatgggatgtgacggtaaaagtgctcagctataccaaccataccattatgtccgaagcgctggaaagctggccgacagatatgatggcacagcttttgccgcgcatttatcaaatcatttgcgaaattgaccgccgctatacagaggatatggcccgtttgtatgaccgggataagattgagcggacaagggtgatttcggacggaagcgtgaagatggcacaccttgcgatcatcgggagccacagcatcaacggggtggcaaagctccatacgaatattttgaaagaaaaagtgcttcgtgacttctaccgcattttcccgtccagatttaacaataaaacaaacggcattacccaccggcgctggctgctgctttccaatgaaccgctgcgtagttttattgacagcaaaatcggcagggagtgggcgacgaaaccgactgacctgaaaatgctcgaacctttccgccgcgacgaaagcgcactcaggcaacttgccgaaatcaaacaaaccaataagcagcggctcgcggactatatcgggaaaacgacagggcttgccatccggacagatgccatttttgatgtgcaggtcaaacgtttccatgcttataaaaggcagctgctgaatcttttgcatattttaagcttgtattttaaattgaaggatgatccggaagcagatatttacccgcgcgtcttcatttttggcggcaaagcggcaccgagttacacctatgccaaggaaatcattaagctgataaacgcagcggcggatctgattaaccatgacccggcagtgagggacaggctgaagatcgtttttattgaaaattacggtgtgtcgctggccgagcggatcatcccggcggctgacgtgagcgaacagatttcactcgcatccaaggaagcgtccgggacgagcaatatgaagtttatgctcaatggcgcggtcacattggccacgctggacggtgccaatgtcgaaatccgcgatctcgtcggggaggacaatattatcctcttcgggctgaccgatcaggaagttttccaatattaccatgaccggtcttatcattcttatgattattataagaacaatccggtgctgcaccgtgtgctcgatgcgctgattgacggctcgattcccggggtgcaggcggaagggcgggatatctttgattccctgattaaatacggggatgagttttttgtattaagagatttcgaggattacgcgctggcgcagaaaaaagtggacaagctttaccgcgagccgctcaaatggcaggagatggcactcgtcaatattgccaatgccggcgtattttcctctgattataccgtgctcaagtatgccggcgagatttggaacgtaaacagcaaaacaaggattttttaaccgatttctgaaaggcttcctgcagggggaaactcgaaaaggactgtttgcttttagctgctgcatactgcccggaattcttccgctaaaaagcagccggcaagggccgggcttttcatggggggaccgggcatccagcagcataagccgttttccgaaattaaattttgtccgaatttttgcttttctgcaggaaaagatgccggcttggcgaatatcatccaatagatttccggcaggagggggagacgcttgaaaaacatttatttttttaccggttttcccgggtttatcgcttcgtcgctgatcaggcggatggcacaattggattatccggccgggcacatttatttgcttgtgcttccggcgatgcggcaaaaagcagaggcggagatcggagaaatttgcaagggagcggaaaacattgcaaaggaacagttcaccgtcattgaaggggatattacaaaagaagggctttcgattgagggagggatgcgcttcaagctggcagaagaagtgacccatgtgttccaccttgccgccatttacgatcttgcggtgaaacgggacatcgcctggcgggtgaatgtaacgggaacagagaatgtaaaccagtgggtaaaaacgcttaaagccttaaaacggtatgtgtatttcagtaccgcttacgtatcgggcaaaagggaagggcgcatttacgaacatgaactcgacatggggcaaacgtttaaaaaccattacgaggagacgaaatttgaagcggaaaagcgcgtccgcggcatcatgggcgatgtgccggttacggtgattcgcccggggattgtaaaagggcattcaaagaccggcgaaaccatcaaatttgacggcatttatttccttttgaatacgcttacgaaatttaaaatttttcccgtgattccgtatttcggcgtgggcacggcggaagggaactttgtcccggtcgattacatttttgacgccaccctttatcttgcccatgcgcatgccggggcgggaaaaacgtatcaccttaccgatccgcatccgtaccgcatgcgcgaattgtacaaaatggtcatggaggtgtatctcggaagaaaaccgcacgggaccatcccgctgtcggtaatggaatggctgttttctattaagactttccggaaatggctgaatgcggagcgggaagcccttgaatattttacatgcagggcagaatatgactgcagcacggcccaaaaagatttagaggggtccgggatttcctgcccggatttcaaagagacattgccggcaatggtccgtttttatcaggcgcacaaagatgaccgcgataagcagctgaagattgtttaaagggagcattccgtatgaacgaagagtcgattcttgcaaaacagcaagccttcttttattcagggaaaacaaagccgtatgcattccgcgccggggcgcttgaggcgctgaaaaaagctgtcatccggcatgaaaaggcgctgtcggatgcgctccggaaagacttgaacaagtcggcgtttgatgcgtatgcaacagaaatcggcattcttctgagcgagctttcatttacattgaaacatttgaaaagatggatgaaaccggagcgggcaaaaacgccgctcacccatgccggttcaaaaagcatgattgtaccggaaccgtacggcacggcgctgattatttcgccatggaactttccgctgcagctttcgcttgtaccgcttgttggcgcagtggccgccggaaactgtgcggtgatcaagccgtcggaatacacgccgcatacttcaaaagctttgaaaaaactggtggaagaaatattcccggaagattttatcgccgtgatcgaaggcggggtagaaacgagccaggcgcttcttgaactgccatttgagccgttcggcggcgtcggggcaagcgggatgggcgcttaccacggaaaggaaagctttaatgccttctcccaccggaaaagtgtgttacgacaaacaaccgtcttcgacatcccgttccgttatccaaatatgaaaaatgggttgacaaaaataaaaagatttttaaaatgaagattgacattttttattttcagcattaagataataatcaatcaatggcaatgaagaagcgtaacctttgtggattccgaagagagccggtgggtggtgcgaaccggtgatgacatgcaggcgaatgggcttccgagcttccaaaccgaaacgtccggagtaggctttggcgaatgccttatcgttacaaaaggcaggtatacggtttttccctgataccgtcaaagccgggctgatcaagccaataaaggtggcaccgcgggtttcccgtcctttacgtggattggggtcctctttatatttttttaaaaaatgggagagggattatgatgcaactgaatcagaggcactttaactgatataaaatacgcgcttcatgaattaattgaaggttttttttatggagaaatgaaagatatggctcacaaatatgcgagtgagcatgagaaaacaaatcttccttttggaatgttgtgtgtaaaccaccaccatttgctgggcggaaaaagcgcttctgtttttcatgtggcagcatgtgtagaactgattatacttgcctttaatattttagatgactggcaagatcaggatcatcatcgctcgccatggatgcaagatcatgcaggccaatcattgacggtggaaacggcctttttgttgttggctatgtcaaaattgaatggatttttaggcagtcaaaaaaataatttggcttttcaactaatcgttgaccgaataaatcgttccgttcatggtcaatttgctgatattcgaaatgcaccattgaaagaagaagaatatattgcagtaattaagcaaaaatcaggagcactttgtgcgctcgcttgcttgtgcggagctatgctagctggtaatactactgatcttcatttaataggtgagtatgcaactggaataggtatttgtgcccagctcgagaacgatcttgatgatgttctccatttgggtgaaaaaaatgatctaattcacaaaaaatggacactggctaccatgtatctcgcccatcacccaagccgaatcggaaaggcagtggcatcttattttgaaaatcggctgtctttagatcgattactagccattcaatcattggaggcatggattcaatcatcaggtgttattctctatacaagagttttaatagaagctgaaaaaataaaagcaaaaaacattattgataaattgtccgttgacgaaaccattaaacgacaaatcaagagctttgttgatggaattcatttcaaggcggatatcccaggagaaacttaagattgtaaatcttagttttttccttaatctttagttggaaacatcattttaaaatatataaatggtattatatggatgatagatgaataatatgggagatgataagatggaaacgtttatttaccagttgatgaagcaaccacatctgattgaagaaattaaagcggggacttttgattacccggaatcttttactgaagaagataaatgtgccgtattgaatgctatcaaaggggagaacagtcaagattatcgtttatgggcctgatataaaatgattagaatgcgctttcttttgctaactggtttatttttgtcgtttatacttgctacgtattttgtgtttgttatttttaagtatccatacataggcattattgtcaaaaaggcggatcatcaaatcgtggtggacagtgtagatccgtacgggtgggcttctgaacagtccatttacaggggggatgttatccggcttattgacggacgttctccaacaaaaaagccatccgtccaacataaggagattattagtgacgctaagaaaataacgatagaacgcgggaaccaggatgtacaatataaaatagataatcatcagcctgttactggaatgatttattattttcttgttccatcggttttctttttggtttgtttttctttaggatgttttttatttaaatttctggataaaaacaagtcaattccagtcctgatcctttttttagcagtaatcgcccccgtattactaaatattagtgccaattcccgaatctacaattggagcaggtatacagtggggatatttatgtgtatcagtctggtattgctgctacattttttgcgaaattattatcattcctcatcacgactggtttcaaaccatgtgctttcttttctatatttaggcgccggacttgttttgataaaccgggtaatcgccgccgattatccgcttgaactgttttttgtgcccgttgtctttatcattcttatgatctctgtttttcgattatattatcaaacgaaaaacagtgaggtgaaaaaatcattacaggtgctttttacgggtatcttccttgcccttatgccatttgtcacactttacgcacttccaatcgtcattttcaaggattcaatcatgccatgggagtggacaacaccttttcttgtttttttaccaattacaacgggctatttggtgctgacttataaaatgattgatttgtcctttattatcaaccggctgcattattattgcttgatgagcctaatgataatgtccgttattttaacgggaacgctcgcttttgatccgggtaaactgtcgggcaatatatttaggattacacgcctggctctgttcgtttttactgttatactgttgtttttatatataaaagattatgtcgaataccggtttagaaaaattatgtttccaaaacggcaggattttcaaatgagcttgaatcgttttttgcaatggatgaagtcggagcataagctggctaatttagcctttattttgaaacgggaaattgaaaactttctgccagctaaggaagttactttagtaaaggtcgatcagaatgggaaagctatttctttactcgacaatactaaagtgaatgtgacacatcactcgatgacgaatgaatgtacagaacgtcttcagatggatgtgcacgggtttaaaatcaacttgtatcatgacaaaagcggcacgatctttttatatgggcgttggaaaatgcgaagaaagctcaatcccgatgaaaagatttggcttgagacgcttttaaactatgcacaggttgtgattgagaatcaggacaaggctgaagaccttatcgctttattaagcttggaaaaagaccgggatttgttgccgcatacagtaaaaaaagcaatttttaacatttcagagcgcgaacgcaagcaattgtcgagggatctacacgacacgatcatacaagagctgctggcactggcgagggatgtcgatatcaaaagggccggttgtgctgatccatttgttattgacatgctgtccgaaattcgggagggaattttaaataacattaaaacattgcgggaaatcatacatcatttacatccggaatttattcacaaaatgggcttgccccttgctctgaatcaattatgccttcaagtacaaaaacaatcatcatttgctttacatatgcatatcgatcagcattttacaatttttgatcgtgaactggaaatcaacatgtatcgtattgtccaagagcttttaaacaacgcgatcaagcattcccaagcagagcatgtaagcttaattttggctgaagaaagcacgaggtatattcttctttacgatgatgatgggattgggatagacaaagatgtactcaaacgccagcatcatttcagcacgatgggatggccaggtttaaacgggcgcgtagccattaccggcggtcaattaaacatagactcacttaaaacaggaaacggtaggaaagggcttcatatagaaattgtctggccaatcaaccggggtttataaatagccagttttacaaggaggagtataatgatggcgtccatacttgtcattgatgatcatcgtttagtggcaagcggtacgaagagtttgctgcaaaacgctggatttgaagcggaagccattttttctgctgattatttaaaagaaaagatagagagtgcgaattatgatgtttttcttattgactggagttttcctgaagtgaacggtctggaaatatcaaaaaaaataatcaaattacagccgcaagctaaaattattatttatacgggttttgattcagaacttgctattgtgttggatcaattaattgaagaaggcatttccgggattatcagtaaaacggcctcagtgaatacattaattaacgctgtccatgccgttatcagtggatatagcatttttccaaatacccttgtgaaagagtctgtttacaccctccggttgaaaaaggaaactgaaaatctgtttagtgaaagagaaatagaaattattgagtgtttaattgacggtgatacgaacaaggaaattgctgctaaactttacatcactcaacgttctgtagagtatcagctgcgctccatttataaaaaattgggcattcattccagagaacaagtggcggatagagtaaaagaaatgaggattatttcgcctgattcatataaaattcatggatagagcggatttgcaaagaattccgcttttttggtattagccaccaatgtttgggcagcagctgtccactttttttcggtgttaccacacaaaaatttcggtgataccccgcaaagatttcggtcatgccacacaaaaatttcggtgacaatggctcttttgtcaattaaaataaacgtgtcattttttaggcacttttttgacaattaaggatcccctcagtgcaaagtaaattaggtcatttgtactgtgtgttggtgatgtctttttttatatcaaatttgattggaggatgaaaagttgatcgaagccaaggacatctccgtttcaattggaggagtacccgtgctgcatgctgagtcagtacgttgcaattccggaaccatgacagctctcgttggtcccagtgggtgtgggaaaaccacacttctgcactgccttgggttgttgctcccggtggatcaaggccagattttatttaatggaaaagatgttacaaagtacaattcatcggcacgacgcaaattttggtgtgatcacgcagccttcatacttcaagattacggaatcatggatgaggagtcgattgctttcaatgtaaccatgcatgcaagtatgtttggtcggcgtttcaggggaaatcgcgaacgcttggcgaaggtacttgagcaaacaggtttacagggccgggaaaaggagctggccggtcacctaagcggaggagaaaaacagcgattagctttagcgcgtgttgtttacaaggatgcggagcttctatttgttgatgagcctactgcttctcttgacgcagtcaatcggaaaaaagtcttccatttgttggtaaaatttgctctgagtggtcgtacagtgattgtgtcaacgcacgattccgagatgattaacgcatgtggtgccaaatatgaagtcggttctaacagttcattacataatccgtcttctactgatttaactggtaatatgggagaaaccttatgaagccggttcataagaaaattattggtgtggttgtcggtttgttgctaatagtgggagcgcttgcgttactgaacggctggttctcaggctcagaggacacgcatccgccgtgcaatcagctgccgactgtgtcgaaggtagatgaggcgattgctagccatcaaaaacttactaaggagataaaatcaataggggatgacattacagttgaagtggggaggccttgctccaaagaccagaaccggggactggtcatggtgaaatatggtacaaaaactgagcgtaaagcgattgatgatcttctcagccgtcgaaacgggttcggggtcccggtatatctggtgaagaactaatgcctatttccaccgtaggatgactttttacattaggaaacagcatggcaataattcatttgttttttttaatatgttggccgaataacagtgtgaaggaaggaaaggaataaatgaaaaaacatgatctgctaatcctcgctattacacagaggctcaacaataataataaaaaacattgggaaacggtgagtcgagtttctgacgttcatggagggtttatctgtgtataagcgtattatcgtggtggttgcgagtgccttgtttgcactacttgcgttgctcgctgcaattatcacaggcctatatgatcgagactttccgcaagccattcatactgggagtaggattagcctagactttagcgaatcaaatatttccattactaaggcatttgacacgttggagaaattagatgcacgctggggtctgggactagtcaaggttgcaccggatcttgagggggatggcgatgctcagattttcgtggcacttaataatgagggcttccccaaggaatttacttggtttggcggcgaaggtacaggtaagatcgttgggaaggagagacttgccacttcttaccctgatggtttatatttagtgaccggaaaggaaacccacttgaatgagttggtgaactcgttaaagcaatcaggtgttaaggtgagtcgtacggatgcgtcaatttttcgcagtctagaatttgtggtgcgggaaaggggatttgctgctgctgttgttgcagcttttgcgctaatcgccgcactggcgttgttttggttgtcgttgagagcacgcgggcgagcgctccgtgttttaggtggatgtccaaccgtacaaatccaaatgcaggatctatcagggttcggtggtgcactactgcttgcggcgttagtcgtggtggtggtttcagcaggctatgtaggtatatttcatggctggatgtacgtaggtgcctttctcaaagctttagtaagtctacaagttgcaatcatcggtgtatccctattcgtagcgtttgttatgtcggcttctgcctggccgagcgccaccatgcttgccaccagacaaccagcagtaaagagcctgcgtgtagcggcaattgtgattcaagtattaacttttctactggtggttgctgcggccggacccgcatggtctacatacaaacactcttcagctatggcagctgaaatggcacagtggaagcaattggcagaccaagtcgccattgtatttgcaacagatgttgatgaaatggacagcttggaaccccaaattggcaaattagtaaaagaagctgaatcgcgtgataaggttgctctatcttatacttttaccaaagaaatggggttaccggctgattctggaaagtattcagcagtctcattcgtgaaccagcgttggctcgacctagtgactaagggtgcaccacagtcagctgttaaaccggtaccttatcgtagtattccaaagggactcattcaaatggttcgtgaagagactaaacttctatcaaggcatggtttttctagggaatcattcggacagcttcagtttatgcaaccagtaaaagggtttcagttaccagtggcccaaggaggtgggggccaaagtcttcactttgctgacgatgtcctggtcgttgttgtgccatcgatttatgatgcatttaacgattctacactaacctccatggcttcaactagtaacattgtgtttaccggtgtggctgctacacagcaattgttaaaaaatcacggccttgatgtgcgcgcgttacgcgaacacggcattcatggtgaacttcatattgcttacattgctgaagatgggattcttcaagcgcagtttgcagcgaatgttgtaaggttgcagagctttgcgctgattgccttggtggttgctttcactgtcgcaacagtgatcagtgcgttgattaccgcgatattacgggcgaaacatgacttcccgcttcggttggcgggtcaatcttgggcacggattttatggaatcgtgtggtcaaggaattgctaattggtaccggccttgcgggcattgttgtcatgctacaaaggccagatgcgatggaagccgtacttgtgatagcagtatatggattgcttgtcgtaccgttaagtcatctttttgctacgcgctattgtttcaatggtgttatcagacgtcgaatttgatggcagtctcagacaattttatatgaaaaatgtttaaatggtcattttatttaatgtgcaatctgaactgttttctgttatataaacgaagttggtttccaacttttcattctatgaaatattttttggattgagatttttgtgggacttctttctttttagggaaatcgctggattattctttttactactattgtttctagggtaataaccattgtagaacataaggaataataaaagacatttgaaattaaaacaaaaataaggtacatgcctgaggccagcagatagagtaaaaaaatgaggattatttcgctgattcatataaaaatccatggatagagcggattcgcacagaattccgcttttttgtattagccatcaatgtttgggtagcatctgtccactttttttcggtgataccacacaaatttttcggtaataccacacaaagatttcggtgacaatggctctagggcctattaaaatatgagtatcagatacattgattagtgtatctttctaaagtttttaatgtccttaataactgataaaaaatatccttgattttcttatgggttgaggaaaaaggattgaagaattcaactattaacaatattaaacaattaatggagagataaacaaatgaaaaaagaaataacatcatcaaatacttattggatttttatttctttattttttatagtaatatttaatgctttttttcaatactgtattcatcaaaaagcgctaaatttgttttggtctcaggttgataaagaaaatcatcttggctcttcaattaatgtaatattttatgctgttcaaagttttacggtgcttacgtcaatagttggcatattaataggagctttagtggttgctttttttggattcctgtttggaattaaaaaaaagaaaaaagattatttattagtttattccctaacttcattatttctttcatttaaacttgtcatagcaggcatagtaaatctgtttcatgcaaatacaagcaaaatctatattgttggaaagcagagttttctttcacaaatagcggatccttttttatggttaagtactgttttatttttccttttaggagttaatattttatcaagcaacagaaaaaaagtattttatttaacactcatttatttgctgattaaatttgtaaatatcggtctctcttattttctaaattatatagtttaataatggggggctattaaactatatatataaaaattaagattggagtgaaatgtatggtaaacagcttatctaacaaaaaaagggtatttctgtttgtggtaattgggctggtactcgccactctgtcatcggttgcgtatatcagcacactacaaatcactattcatcaaactgcagttttgcctggcaatgcttacttagcaagcactcttggcatttccaccgccgcagcaaagaaggctatcgatattatcgatactgcttcaacgattgcatcaattatttctttaattggtgttgttacaggcgctggagctatctcttacgctgttgtcgctactgctaaagcgatgatcaaaaaatacggtaaaaagtacgcggcagcttggtaattagcattacctgcccccccttttttagtttgaagaaagagttgacgagtttatgaaaaataataattatagtatactgtattatattgtgaaatttaatatgctctcaaagacaagaaaaaaattagacgattggaatctgaatcatattggggttaaaaaggccttttatgctttattatcctttatctttctcacttcattactagtgtttattttgtcgttttatattagtaagaaatacatgctcccaaatacatatttacagttactgttggtattcattttcattgaacaaatcgcttcgtccctaagttttttcaaaaacaatagagactattttttaaaagatgaaagaaagttaatccatcaaaatagaaggattaggattgttcagttgaaatctgttttagtatataaaactattgaaaaagcaatgctaacaagtattttaatattaatacccgttttattagctttaaacctaacccaaaactcaattatcggtatatttgatttgcttctcatagtacttatgtatttctttgttaactttttcttgtcgttgttattctcttacattccatatattttatcaattttatggtcaagagcattaaaatcatccattataaaaataattgcattaattattaacctattggtacctgtgattattggcttcttcggattttatttgctgaataaatttaatattgtacagtccctgtatgaattatcccatactaaaatattttattattttaaagtggcaaacccttatcaagtaatttgtaaaaataacatttcctccgacttaatcattgtttcaattttggcggtttcatgtgtgcttgtatatataatatggagcaaaactttagagagattcgacttaatagagtacacgaaattaaataatcgagtttactcaaacacaataccgctagcaaataaaaagaaaatattttattgtatcttacataaagatagagcttttctattaagaatcgatggtttcttttttagaaatcttggcaacatgctatttttggttatgttttttcttggatttggtttcccttttatcttaagatactttagtggctatcctgttcaagcatcgattatttccgcttttttaatttcttcattgttctatcagcttgttggagatgcaataaaaatgattctttccgttgaattagatttaaaaaattaccatattttttattctaatgtatttaatttatgggaattagcaaaaccaaaattaagaaattataatcttattgtttggtttctaacgatttttctaacttttatttcttttttctggcaaccttatttcattctgcttcattttgtattttttattatatttttgtgtaacggttatttatatagccttattcaaacaagtagtgttttactgtatccaaaaaagaactgggagcatttctatgaaatcggggaatcaagtaaagcaaaaacatttcaacatatctacgaaggatgtatctttgtcattatattacaaatgataagtctcgtcagtttcctgttaatgaaattcagtactttttcttcaattatacttttaagccttgggacagttatgattgtttttactttacttaattatttattctctatgttatatctaaaaaagattaacatgaatgagaggtacattttgaatgatagagattaaaaatattaaaaaacgattcgataaaaaaattgttctgagggggctttctctggaaattaaagacggcgatttttttggaatattagggacaaacggtgtagggaaaacaactttgttaaaaattattgcagggatgatggttcctgatagtggggaagtcaccataaatggagaaaaacaagacattaaaaattatgcattgcaaaatcttataggatttgtaccggatcacgctattttatacgaatatcttacgggagaagagtatctgtattttgttggcggaatgtttaatgtgccaaaaaagaaaattgtcgaatttgccgcgaatatccttaatgattttgaattgtataatgagaaagatcaattaataaaaacgtattctcatggaatgaagcaaaagatttcgatagcggctgctctaatacatgagcctcaaattttaatattagatgaaccgcttacgggaatagatttaaaatcaagtaaggttataaggaaatttctaaaagattacacggataaaggaaaaacagtgctcataacaactcacttattagaattagctcattctgtttgcaaccaaatagcaatcatccatgaaggcaaacttgccagaaaaataaccgtgcaagattatagcttggataaattagaggaggaagtagaaaacatatatgtataaagttccctctattttaagaaacaattggattttgttgacgattacaacagcaatctatgtttcgggttttgtatacggtatcacatccgctgatccagttaataaaagcggaagtttaaatacaacatctagtctgatacatctaattgacaataatttattagcgtgcggtctgatcatttccggtttttttacgtttggtttaactacaattttatatttatttacaaatggattaatccttggcgaatccattatgaataatctggactttggtgtattaaaaattgttttattgattttaccacatggaatattcgaaattcctgctttaattgtaagtggagtaattggttttaaaggtattactctaattcctcaattgttccacaagaaaaatatcagcaactttatcaaagattattttacaaatatactgctattactaattgtggtaatgctatttattatgatcagcggtttaatagaaacctatttgacaccattattcaaatagaaaggataggaaaatgaaaaaaataggtgaaatcttatatttgattggaattccgcttgttttagctttcggattgattatatcccattattatccatttttattgccagtaagtactttcgggttatttggtttatatatgtttttgtttagcccatttaaaaagatttttgcacgaatactatttatcacagtatttattgtaaacttaatcggcagtgttcttttatattttgcctgaaaggagatgggatagttggttaacaagtatgcaatttttatagttgcacttatattttttattctagcagttacagtcaagccggtttttgaacttataggttggaatcttccggatagaacattaaatatggtggcagttatttttggcctcctcgcactttgcatatcgttaataacagccgtcattgccgttatcgattttaaaaagtagatttccatagttgcgttttaagccacatttattaacaagaaataaaaacatatttatgaacgaggttttatcatgaatgaagagacagctaacgggaagaaaaatctcattattgctttgattattattgccgccctttttggagtgctgtgcttggtaattgttttaaggacgaatgcaagtttaaaaagcgaaccccattaccagcaatatgtggtcaaatatactccggcgttagttgaaacagggaaggtttcagcaaagcagacacagaatttgcaactaccggatggtacagtacaaaaagtaaatgtacggaacggtgatgaagtgaaaaaaggggatgttctcttaacaacccataataacgaaatcatagagaagattactgaggtgaaacagagtattttaaaaatacagcgcgacttagcggttcaaaaacaaaacattgcttatcttaaaaagaaattatcagcagtacaccaagaagagaataaagaggagctgaatcttgaaattgcaagagatcagaatacctatcgagatacagaagctggtttgcaaaatcaacaggatcaattaaatcagctggagaatagagtggagggcaggttaaaagcaccgtttgatggtgtggtgagtatttccactaataatagcggccaatcgcaatacagcatcagctcggatgctttagaggtccagtcgagtgtttccgaatatgactatgacaagttgcgtgtagggagtaaagtggttattaaggccttggcaaacgggaagaggcagaccacaaccattcagtttatttccaaaataccctcaaaaaccgctactaagaaaggcttttcaatgtatgacttcacggtcgatgtggatcgccgctttatggcaggccaaagcgtgcaaatcacaataccacaaaagcaaataaagcttccgagcaaagccattatcaaaaagaatggtcaaacggccgtttatttagtcgtaaatggaaaagcacgttttcgcactgtggcggtagagaaacagaacggtttctacaccctcaaaagcggattgcaccccggcgatcgtattgtggctgatccggacaaacgactaaaagatggagcgaaggtgaactgattgattcgattagaacggctcaacaagtattatcaacaaggagatgaaaaaattcatgtgctgaaggatatttctttggaaattaatcaaggagagttcgtggcaattatggggccgtcgggttcgggcaaatcaacgctcattaatatcattggctttcttgataatcaatttgagggtgaatacttgtttaagaggaattcggtaattggcaagtcatcaaaagactatgcaaagttgcgaaatcaaaacgtgggcttcgttttccaaaattttaaactgattgcgaatttaacggttgctgagaatgttggtttaccgttgctttatgccggataccgccgaaaggacatcggcgaacgagtgaataatgtattgcaaagtgtgcatttaaaaggaattgctaaaaagttgccgtcccagctgtcgggcggccagcaacagcgtgttgccattgcccgcgcccttatatccaagccgagtttcttactggccgatgagcccactggcgcacttgacaggcatacttcgcaagagattttaaaactgttccttgacttaaatcaaaaattacgatccaccattattatggttacgcacgattaccaagttgccagccagagccaacgtatgattcaaattatggatggccggattgaaagcgataggagcgtcagcaaatgagggcagccgaactgttttttactgcaatacgttcgcttttggcgaatcgaaggcgaagtattttaacaatgttgggcatcgttatcggcattgcctcggtgattacgattatttccttaggtaaaggcgttgagaaagcaactcttaaaaatttacaggcgtccaattcgggcaagcagtcaactgtcgtggagtattatgctgacgatttgaacgcggccgaatctggttttaatgagtcggatctatcgttattaaattccgccggggcaagcttcggactggcagaggctcatattattaacgatgacaatgggacagtcgatgtccaggcttcgctaaatggtagcgaacaaaacgtaacagtaaagcttcttaaacgttcttcttcggaacaagagatttctgctggccataatatctctcaaaataatatcacattcgctgatcctgttgctttaatttcaaaaaaattggcggcttctatttatattcaacccaatcgtgccttagatacggctgtcatcgtgaatgggattagctaccatgttatcggagtctttgaaaatgccgatgattttcatgatataatgattcccaaaaaggtttataagaaaagtaatatcagcaacgtgggaaataaattaaaactggtcttcaatcgcggggaaaacgtcagtaaacaaacaaaaaaaatcgtcagcctgctcaacaagcagggcagccatcatttgcaggggagctatgagcatatagaaatggggcaaatcttgaaaggcattggatcagtcattaacagtttaacctacttcattagcgcaattgccgggatttcgctgtttattgctgggattggggtaatgaacatgatgtatatttctgtctctgaacgtacccgggaaattggcattcgtctcgctatcggcgcaaccccaaagaatatcttattccagttccttttggaagcggtgttgttgacgggaataggcggcttgattggttttgggataggtggtggactcgcgtggctcatttcgctcttcttacctttccgtgccgtgatcggtgtaggaagctttttactcgctttttgcgtctctacctttgtcggcattctatttggcatattgccggctaaaaatgcagccaataagaacttgatcgatattttgcgttaggatgttgattggaagaatacagtggtctaaacaatgatgaatgtgcaaagtaaaatgtcctaaccggaccccttcttcgaacgaagtggccatgcgtgccctttcgcgtattttttcccgggtaggccaagtcactttttcacaaggaagacaaggtttgtccgccaaatgttacttggaaaaatgggctgaaaaaaataaaaaaatttttgaaatgaaggttgacaattcttattttcagcattaagataataatcaatcaatgaaacatttttcaggcgatgaagaagaagagtaacctgtgtggattccgaagagagccggtgggtggtgcgaaccggtgatgacgtgcaggcgaatgggcttccgagcttccaaaccgaaacgattccggagtaggctttggcgaatgccttatcgttacaaaaggcaggtattacggtttttccctgataccgtcaaagccgggctgattaagccaataaaggtggcaccgcgggttccccgtcctttacatggattgggaaccctttttgcgttccgttaaaaaaattccataaaagaaaatcgttgagtaagaagagtatgcaaatggcaagcgttccagagagccggcgtgggtgggagtccggcacgaactgcctttgcagaatgggcttatgagaggtttcctgaactgtgtagtagggaaacacggattcccccgttacagggatagggtataaagagtggcttgctccgtacccgaatgagcggaaaggttttaaatcctttcaaaagaggtggcaccgcgttggaaaacgtcctctgtcctgcagcatataactgcgggcagaggacgttttttatttagccgggaaccgggatctgtaatcggaacccgcctgttaagtgaaggatatctagccggttcagccaggtggcagccggagcgcgaaaaaccacctagttgtaaccattaataaaaaaggagagcggacggatgcaatacaaaatggttaagctaaacggcgacgttttaacgcctatcatgatttttacgagactgaaaggaaaatgcaagtttttgttcgaaagttcgctgccaaatgacagcaacggccggttttcttttatcggggctgatccggtaaaagcgttcatcgggcgggatgatgaactggaagtgattgaccggatgacaggacggcgagaaataaaaaaaggaaagccgctcgatattgtcaaagacctgttgccgcgtcttggcattcagcttccctttccgttttacggcggggcggtcggctatatcggctatgacgccatccgccagtatgaagagatcggccgtgtgccggaagatgaaacaggaatccccgatctgcatttgatgctgtaccaaaacatagctgtttacgaccataaaagccagaccgtctaccttgtttcaaccggggaagacggggaggaaatagaaaaaagtcttgcggcaatggaaaaagcgattcgccagcagacgagcgcagaaccatttgtcgactatggcccggttgattttgccccggccattcaaaaacaggcatttatggagatggtcgaaaccgcaaaacagcatatcgaaaacggggacattttccaggttgtcctctcacagcgcatgaaagggacgctctcgcacgacccgttctatttttaccggaagttaaggaaagcgaacccgtccccgtacatgttttatctcgacttcggcggctatgtcatcctcggggcatcgccggaaagcctgatcaaaacgaaggggcgtgtggtatatacgaacccgattgcgggaacgcgcccgcgcgccaaagtcccggaagaagatgagcgacttgaaaacgagcttttacacgatgaaaaagaacttgccgaacataaaatgctcgttgatctgagccggaacgacctcggccgggtgtgcgagcccggcagcatccgggtgcaaaaatatatggaagtcgagcggttccagcatgtgatgcacatcgtttcggaagtacggggaaaattgcgggacggttttagcggaattgatgcgctcatctcctgtctcccggccggcacggtatcaggcgcgccgaaaatccgcgcgatgcagatcatcaacagcctggaaaccctgaagcgcggcatgtacgcgggagcggttggctatatcaacctgaacggcgacatcgattttgcgctcgccatccgctcgctcctgattaaagacaacaccgcttatttgcagtcgggcgcaggcattgtctacgattccgatccggaaaaagagtatgaagaaacgctcaacaaggcgagatcgattctggaggtacagacacatgattttattgctcgataactatgactcttttacttacaacttgtatcagtatttttgcgaacttggggaggaagtaaaggtgttccgcaatgaccggatcaccgtggatgaaatcagaaggctcaagccggaagcgattgtcctctcgccggggcccggggtgccggaaaatgccggcatttccattgaagtcgttaaaacattttaccggcaaatcccgctgctcggcgtctgcctcggccatcaggcaatcgccgcggcattcgggggagggatcacaaaagcaaaagaaatcaagcatggcaaaacttcgcttgtgcgccatgaggggaaaggaattttcagcggcctgccggatccggtcgaagtgatgcgctaccactcgcttgtcatggaccggacaaagatcccggaagtcctggaagtggttgccgaatctcttgatgacggcgaaatcatggccattcaacatcaatccgccccatgcttcggcgtccagtttcatcccgagtcgatcgggacggaaaccggcaaacagatgcttgaaaattttttacgcgaaatcagaaaggatgagaaagttgaaaccgtatcttgaaaaaattttggcacaagaagggctgacgtttgaagaaatgcgggaagcatcccgcgcactgttttcagatgaagtgacagaaggggagatgggcgcatttttggccgtcttgaaatgcaaaggcgaaacggcggaagaaattgccgggctggtcgaagtgatccgtgaaaaagccgtgccggttccgtgcagcgttcccggactgatggacaactgcgggacgggcggggacggcagccacagttttaatattagctcgacctccgcgtttgtgctggcggcaagcggcgtgaaggtcgccaaacatggcaaccgcagcgtctcaagccagaccggaagcgccgatgtccttgaaaaactcgggatttccttgtctttcccggcggaagaaattgaaggcttgctgagagaaatcggcatcgtcttcctgtttgccccgaatgtccatccggccctcggaaaaatgatgaaaatccggaaagatttgcggatcccgacgatttttaacctgatcggcccgctcacaaacccgatgaacctggaaacacaactgcttgggctttaccggcgcgatatgctcaggacgatggcagaagtacttggccgccttggcagaaaacgcgcgctcgttgtcaatggcgccggctatcttgatgaagcatctttatcgggggaaaaccattttgcgctgctcgacggcgggaaaattaccacgtttacgctgacgccggaagaagtcggtttgccgtattacccgcttgaagcgatccgcggcggcgatgcacaaaaaaacagcgatattttgctgtcagtattgaagggagaaaaaggtgcttatcgtgatacggtgctcttcaatgccgggcttgcgctctttgctgcagggcgggcagagacggtaaaagaagggatccggattgcggagcaggcaatcgaatcgggcgcggcacttgaaaaactgcacgcgctcattgaagcgagccggaaactcacgcaggaggcgatttaaatggcatttttagaaaagattttagccgaaaaagaaaaagaagtggcccgtatcaaagctgcaggaaaggcttttgccccaaacgcgcgcaaagccccttctctttatgaaa
